United States Patent 12,569,549 (FLAVIVIRUS VACCINE) - sequence listing, part 33

SEQ ID NO: 12953 - RNA, 9873 nt, synthetic construct
  misc_feature 1..9873: note = derived and/or modified CDS sequence (opt2) from DENV-3__FJ562102__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgccatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccttcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcctaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcatcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacctcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactggatccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12954 - RNA, 9873 nt, synthetic construct
  misc_feature 1..9873: note = derived and/or modified CDS sequence (opt2) from DENV-3__FJ410229__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgccatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcctaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcatcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacctcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactggatccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12955 - RNA, 9873 nt, synthetic construct
  misc_feature 1..9873: note = derived and/or modified CDS sequence (opt2) from DENV-3__FJ461326__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatctccacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggcccgcaacaagcccaccctcgacatcgagctccagaagaccgaggccacccagctcgccaccctccgcaagctctgcatcgagggcaagatcaccaacatcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgccatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcctaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgacgtccccctccagtggatcgcctccgccatcatcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacctcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgcaagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactggatccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12956 - RNA, 9873 nt, synthetic construct
  misc_feature 1..9873: note = derived and/or modified CDS sequence (opt2) from DENV-3__FJ461329__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgccatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgaggactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcctaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacctcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactggatccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcaacgaggagttcctcgactacatgccctccatgaagcgcttccgcaaggaggaggagtccgagggcgccatctggtga

SEQ ID NO: 12957 - RNA, 9873 nt, synthetic construct
  misc_feature 1..9873: note = derived and/or modified CDS sequence (opt2) from DENV-3__KF955459__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgccatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccgccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcctaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcatcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacctcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactggatccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12958 - RNA, 9873 nt, synthetic construct
  misc_feature 1..9873: note = derived and/or modified CDS sequence (opt2) from DENV-3__FJ547066__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgagatggagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgccatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcctaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcatcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacctcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgagggcttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactggatccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12959 - RNA, 9873 nt, synthetic construct
  misc_feature 1..9873: note = derived and/or modified CDS sequence (opt2) from DENV-3__KF955460__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcaccctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcaacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgccatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagaaggacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcctaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactggatccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacatcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12960 - RNA, 9873 nt, synthetic construct
  misc_feature 1..9873: note = derived and/or modified CDS sequence (opt2) from DENV-3__FJ461334__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgccatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccacccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcctaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcatcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacctcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactggatccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12961 - RNA, 9873 nt, synthetic construct
  misc_feature 1..9873: note = derived and/or modified CDS sequence (opt2) from DENV-3__FJ461337__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccatgggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgccatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgaggactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccgccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcctaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacctcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactggatccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12962 - RNA, 9873 nt, synthetic construct
  misc_feature 1..9873: note = derived and/or modified CDS sequence (opt2) from DENV-3__FJ461338__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcgtcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaacaagaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgccatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcctaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactggatccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12963 - RNA, 9873 nt, synthetic construct
  misc_feature 1..9873: note = derived and/or modified CDS sequence (opt2) from DENV-3__FJ562103__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctaccgctgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcaccctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcaacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgccatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagaaggacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcctaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactggatccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacatcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12964 - RNA, 9873 nt, synthetic construct
  misc_feature 1..9873: note = derived and/or modified CDS sequence (opt2) from DENV-3__FJ898456__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccttccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacgtcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagtccatcgagggcaaggccgtccagcacgagaacctcaagtacaccgtcatcatcaccgtccacaccggcgaccagcaccaggtcggcaacgagacccagggcgtcaccgccgagatcaccccccaggcctccaccgtcgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaacaagaaggagctcctcgtcaccttcaagaacgcccacgccaagaagcaggaggtcgtcgtcctcggctcccaggagggcgccatgcacaccgccctcaccggcgccaccgagatccagacctccggcggcacctccatcttcgccggccacctcaagtgccgcctcaagatggacaagctcgagctcaagggcatgtcctacgccatgtgcctcaacgccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccatcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccatcgtcgtcggcgacgtcatcggcatcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgagatgtacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggccgacaacttcaccatgggcgtcctctgcctcgccatcttcttcgaggaggtcatgcgcggcaagttcggcaagaagcacatgatcgccggcgccctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcgtctccctcatgtgctccaacaccatcttcaccctcaccgtcgcctggcgcaccgccaccctcatcctcgccgtcatctccctcctccccgtctgccagtcctcctccatgcgcaagaccgactggctccccatgaccgtcgccgccatgggcgtcccctccctccccctcttcatcttctccctcaaggacaccctcaagcgccgctcctggcccctcaacgagggcgtcatggccgtcggcctcgtctccatcctcgcctcctccttcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggccaacgtcaagaaggacctcatctcctacggcggcggctggaagctctccgcccagtggcagaagggcgaggaggtccaggtcatcgccgtcgagcccggcaagaaccccaagtccttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcgtcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcaacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgtcgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcgtcgcctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccttctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgagcgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatccgccgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagcgcccccgcctctgcacccgcgaggagttcatcaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccgcctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctcctcgagaagaaggtcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtgggccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcgcctcccgcgccacctgggcccagaacatcctcaccgccatccagcaggtccgctccctcatcggcaacgaggagttcctcgactacatgccctccatgaagcgcttccgcaaggaggaggagtccgagggcgccatctggtga

SEQ ID NO: 12965 - RNA, 9873 nt, synthetic construct
  misc_feature 1..9873: note = derived and/or modified CDS sequence (opt2) from DENV-3__JN697379__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagtccatcgagggcaaggtcgtccagcacgagaacctcaagtacaccgtcatcatcaccgtccacaccggcgaccagcaccaggtcggcaacgagacccagggcgtcaccgccgagatcacctcccaggcctccaccgccgaggtcatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagacctccggcggcacctccatcttcgccggccacctcaagtgccgcctcaagatggacaagctcaagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtaccgcaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgccatcggcatcatcaccctctacctcggcgtcgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcaccggcgtcctcgagcagggcaagcgcaccctcaccccccagcccatggagctcaagtactcctggaagacctggggcaaggccaagatcgtcaccgccgagacccagaactcctccttcatcatcgacggcccctccacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatctccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgcctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgtctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccgccaccctccgcctccccgaggacatcgagcagatggccaacggcatcgccctcggcctcatggccctcaagctcatcacccagttcgagacctaccagctctggaccgccctcgtctccctcacctgctccaacaccatcttcaccctcaccgtcgcctggcgcaccgccaccctcatcctcgccggcatctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgtcgcctccgccgcccagcgccgcggccgcgtcggccgcaacccccagaaggagaacgaccagtacatcttcatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcgccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggtcctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagcgcccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccaccccctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggaccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcaacgaggagttcctcgactacatgccctccatgaagcgcttccgcaaggaggaggagtccgagggcgccatctggtga

SEQ ID NO: 12966 - RNA, 9873 nt, synthetic construct
  misc_feature 1..9873: note = derived and/or modified CDS sequence (opt2) from DENV-3__JQ045687__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcgtcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaacaagaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgccatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccaccatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcctaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactggatccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12967 - RNA, 9873 nt, synthetic construct
  misc_feature 1..9873: note = derived and/or modified CDS sequence (opt2) from DENV-3__JQ045689__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccagttcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgccatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcacccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactggatccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacatcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12968 - RNA, 9873 nt, synthetic construct
  misc_feature 1..9873: note = derived and/or modified CDS sequence (opt2) from DENV-3__JQ045691__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacatcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagatctccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgccatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagaagcgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcctctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacctcgtcaagctcatgtccggcaaggacgtcttctacctcccccccgagaagtgcgacaccctcctctgcgacatcggcgagtcctccccctcctccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgcgccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaactcccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactggatccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12969 - RNA, 9873 nt, synthetic construct
  misc_feature 1..9873: note = derived and/or modified CDS sequence (opt2) from DENV-3__JQ045692__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagatctccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgccatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgaggcccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccttcctcctcctcggcctcatgatcctcctcaccggcggcgccatgctcttcctcctctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacctcgtcaagctcatgtccggcaaggacgtcttctacctcccccccgagaagtgcgacaccctcctctgcgacatcggcgagtcctccccctcctccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgcgccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactggatccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12970 - RNA, 9873 nt, synthetic construct
  misc_feature 1..9873: note = derived and/or modified CDS sequence (opt2) from DENV-3__JQ045694__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgccatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcctaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatgtccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggcccccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacctcgtcaagctcatgtccggccgcgacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcacccagtggctcgagaccgagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactggatccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12971 - RNA, 9873 nt, synthetic construct
  misc_feature 1..9873: note = derived and/or modified CDS sequence (opt2) from DENV-3__GU363549__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacgagcagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacaccatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagatgtgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcctcaccttcatgctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccatccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcctcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgcgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgtcgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatcaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacccacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccgccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatccgccgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagcgcccccgcctctgcacccgcgaggagttcaccaagaaggtccgcaccaacgccgccatgggcgccgtcttcaccgaggagaaccagtgggactccgccaaggccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatgaaccccgagcaccgcctcctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatctccaccgccatccagcaggtccgctccctcatcggcaacgaggagttcctcgactacatgccctccatgaagcgcttccgcaaggaggaggagtccgagggcgccatctggtga

SEQ ID NO: 12972 - RNA, 9873 nt, synthetic construct
  misc_feature 1..9873: note = derived and/or modified CDS sequence (opt2) from DENV-3__KJ622197__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatggccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagtccatcgagggcaaggtcgtccagcacgagaacctcaagtacaccgtcaccatcaccgtccacaccggcgaccagcaccaggtcggcaacgacacccagggcgtcaccgccgagatcaccccccaggcctccaccgtcgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccatcaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttcggcggcgtctcctggatcatgaagatcggcatcggcgtcctcctcacctggatcggcctcaactccaagaacacctccatgtccttctcctgcatcgtcatcggcatcatcaccctctacctcggcaccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagatccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagacctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcctcaccttcatgctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccgtctgccagtcctcctccatgcgcaagaccgactggctccccgtcgccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggccgcaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccaggccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccaaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgccgcgagttcgagctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacaccgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagcgcccccgcctctgcacccgcgaggagttcaccaagaaggtccgcaccaacgccgccatgggcgccgtcttcaccgaggagaaccagtgggagtccgcccgcgccgccgtcgaggacgaggagttctggaagctcgtcggccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12973 - RNA, 9873 nt, synthetic construct
  misc_feature 1..9873: note = derived and/or modified CDS sequence (opt2) from DENV-3__KJ622198__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatggccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagtccatcgagggcaaggtcgtccagcacgagaacctcaagtacaccgtcaccatcaccgtccacaccggcgaccagcaccaggtcggcaacgacacccagggcgtcaccgccgagatcaccccccaggcctccaccgtcgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccatcaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttcggcggcgtctcctggatcatgaagatcggcatcggcgtcctcctcacctggatcggcctcaactccaagaacacctccatgtccttctcctgcatcgtcatcggcatcatcaccctctacctcggcaccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagatccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagacctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcctcaccttcatgctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccgtctgccagtcctcctccatgcgcaagaccgactggctccccgtcgccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggccgcaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccaggccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccaaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgccgcgagttcgagctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacaccgtcaagctcatgtccggcaaggacgtcttctacctcccccccgagaagtgcgacaccctcctctgcgacatcggcgagtccctcccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagcgcccccgcctctgcacccgcgaggagttcaccaagaaggtccgcaccaacgccgccatgggcgccgtcttcaccgaggagaaccagtgggagtccgcccgcgccgccgtcgaggacgaggagttctggaagctcgtcggccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12974 - RNA, 9873 nt, synthetic construct
  misc_feature 1..9873: note = derived and/or modified CDS sequence (opt2) from DENV-3__KJ622191__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatggccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagtccatcgagggcaaggtcgtccagcacgagaacctcaagtacaccgtcaccatcaccgtccacaccggcgaccagcaccaggtcggcaacgacacccagggcgtcaccgccgagatcaccccccaggcctccaccgtcgaggccatcctccccgagtacggcaccctcggcctcgagtgctccccccgcaccggcctcgacttcaacgaggtcatcctcctcaccatgaagaacaaggcctggatggtccaccgccagtggttcttcgacctccccctcccctggacctccggcgccatcaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttcggcggcgtctcctggatcatgaagatcggcatcggcgtcctcctcacctggatcggcctcaactccaagaacacctccatgtccttctcctgcatcgtcatcggcatcatcaccctctacctcggcaccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagatccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagacctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcctcaccttcatgctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccgtctgccagtcctcctccatgcgcaagaccgactggctccccgtcgccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggccgcaaccccaagaacttccagaccatgcccggcatcttccagaccaccatgggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccaggccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgccgcgagttcgagctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacaccgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagcgcccccgcctctgcacccgcgaggagttcaccaagaaggtccgcaccaacgccgccatgggcgccgtcttcaccgaggagaaccagtgggagtccgcccgcgccgccgtcgaggacgaggagttctggaagctcgtcggccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12975 - RNA, 9873 nt, synthetic construct
  misc_feature 1..9873: note = derived and/or modified CDS sequence (opt2) from DENV-3__KJ622192__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatggccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagtccatcgagggcaaggtcgtccagcacgagaacctcaagtacaccgtcaccatcaccgtccacaccggcgaccagcaccaggtcggcaacgacacccagggcgtcaccgccgagatcaccccccaggcctccaccgtcgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccatcaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttcggcggcgtctcctggatcatgaagatcggcatcggcgtcctcctcacctggatcggcctcaactccaagaacacctccatgtccttctcctgcatcgtcatcggcatcatcaccctctacctcggcaccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagatccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagacctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcctcaccttcatgctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccgtctgccagtcctcctccatgcgcaagaccgactggctccccgtcgccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggccgcaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccaggccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgccgcgagttcgagctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacaccgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagcgcccccgcctctgcacccgcgaggagttcaccaagaaggtccgcaccaacgccgccatgggcgccgtcttcaccgaggagaaccagtgggagtccgcccgcgccgccgtcgaggacgaggagttctggaagctcgtcggccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12976 - RNA, 9873 nt, synthetic construct
  misc_feature 1..9873: note = derived and/or modified CDS sequence (opt2) from DENV-3__KJ622193__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatggccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagtccatcgagggcaaggtcgtccagcacgagaacctcaagtacaccgtcaccatcaccgtccacaccggcgaccagcaccaggtcggcaacgacacccagggcgtcaccgccgagatcaccccccaggcctccaccgtcgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccatcaccgagacccccacctggaaccgcaaggagctcctcgtcaccttcaagaacgcccacgccaagaagcagggcgtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttcggcggcgtctcctggatcatgaagatcggcatcggcgtcctcctcacctggatcggcctcaactccaagaacacctccatgtccttctcctgcatcgtcatcggcatcatcaccctctacctcggcaccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagatccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagacctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcctcaccttcatgctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccgtctgccagtcctcctccatgcgcaagaccgactggctccccgtcgccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggccgcaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccaggccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgccgcgagttcgagctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacaccgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagcgcccccgcctctgcacccgcgaggagttcaccaagaaggtccgcaccaacgccgccatgggcgccgtcttcaccgaggagaaccagtgggagtccgcccgcgccgccgtcgaggacgaggagttctggaagctcgtcggccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12977 - RNA, 9873 nt, synthetic construct
  misc_feature 1..9873: note = derived and/or modified CDS sequence (opt2) from DENV-3__KJ622194__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatggccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagtccatcgagggcaaggtcgtccagcacgagaacctcaagtacaccgtcaccatcaccgtccacaccggcgaccagcaccaggtcggcaacgacacccagggcgtcaccgccgagatcaccccccaggcctccaccgtcgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccatcaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttcggcggcgtctcctggatcatgaagatcggcatcggcgtcctcctcacctggatcggcctcaactccaagaacacctccatgtccttctcctgcatcgtcatcggcatcatcaccctctacctcggcaccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagatccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagacctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcctcaccttcatgctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccgtctgccagtcctcctccatgcgcaagaccgactggctccccgtcgccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccactccggcaagcgcctcgagcccaactgggcctccgtcaagaaggacctcatctcctacggcggcggctggcgcctctccgcccagtggcagaagggcgaggaggtccaggtcatcgccgtcgagcccggccgcaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccaggccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacgccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgccgcgagttcgagctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacaccgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagcgcccccgcctctgcacccgcgaggagttcaccaagaaggtccgcaccaacgccgccatgggcgccgtcttcaccgaggagaaccagtgggagtccgcccgcgccgccgtcgaggacgaggagttctggaagctcgtcggccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12978 - RNA, 9873 nt, synthetic construct
  misc_feature 1..9873: note = derived and/or modified CDS sequence (opt2) from DENV-3__KJ622195__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatggccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagtccatcgagggcaaggtcgtccagcacgagaacctcaagtacaccgtcaccatcaccgtccacaccggcgaccagcaccaggtcggcaacgacacccagggcgtcaccgccgagatcaccccccaggcctccaccgtcgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccatcaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttcggcggcgtctcctggatcatgaagatcggcatcggcgtcctcctcacctggatcggcctcaactccaagaacacctccatgtccttctcctgcatcgtcatcggcatcatcaccctctacctcggcaccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagatccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagacctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcctcaccttcatgctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccgtctgccagtcctcctccatgcgcaagaccgactggctccccgtcgccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggccgcaaccccaagaacttccagaccatgcccggcatcttccagaccaccaccggcgagatcggcgccatcgccctcgacttcaagcccggcacctccggctcccccatcatcgaccgcgagggcaaggtcgtcggcctctacggcaacggcgtcgtcaccaagaacggcggctacgtctccggcatcgcccaggccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccaaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgccgcgagttcgagctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacaccgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagcgcccccgcctctgcacccgcgaggagttcaccaagaaggtccgcaccaacgccgccatgggcgccgtcttcaccgaggagaaccagtgggagtccgcccgcgccgccgtcgaggacgaggagttctggaagctcgtcggccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12979 - RNA, 9873 nt, synthetic construct
  misc_feature 1..9873: note = derived and/or modified CDS sequence (opt2) from DENV-3__KJ622196__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatggccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagtccatcgagggcaaggtcgtccagcacgagaacctcaagtacaccgtcaccatcaccgtccacaccggcgaccagcaccaggtcggcaacgacacccagggcgtcaccgccgagatcaccccccaggcctccaccgtcgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccatcaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttcggcggcgtctcctggatcatgaagatcggcatcggcgtcctcctcacctggatcggcctcaactccaagaacacctccatgtccttctcctgcatcgtcatcggcatcatcaccctctacctcggcaccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagatccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagacctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcctcaccttcatgctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccgtctgccagtcctcctccatgcgcaagaccgactggctccccgtcgccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggccgcaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccaggccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccaaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgccgcgagttcgagctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacaccgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccacatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagcgcccccgcctctgcacccgcgaggagttcaccaagaaggtccgcaccaacgccgccatgggcgccgtcttcaccgaggagaaccagtgggagtccgcccgcgccgccgtcgaggacgaggagttctggaagctcgtcggccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12980 - RNA, 9873 nt, synthetic construct
  misc_feature 1..9873: note = derived and/or modified CDS sequence (opt2) from DENV-3__KJ830751__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctgggcctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacaccatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagtcctgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctctacgaggaggtcatgcgcggcaagttcggcaagaagcacatgatcgccggcgtcttcttcaccttcgtcctcctcctctccggccagatcacctggcgcaacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgacgacatcgagcagatggccaacggcatcgccctcggcctcatggccctcaagctcatcacccagttcgagacctaccagctctggaccgccctcgtctccctcacctgctccaacaccatgttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttcaacctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagatcgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcctccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgaggtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcgtccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagcgcccccgcctctgcacccgcgaggagttcaccaagaaggtccgcaccaacgccgccatgggcgccgtcttcaccgaggagaaccagtgggactccgccaaggccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcatccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcgtccgccagatggagggcgagggcgtcctcaccaaggccgacctcgagaactcccacctccccgagaagaagatcacccagtggctcgagaccaagggcgtcgagcgcctcaagcgcatggccatctccggcgacgactgcgtcgtcaagcccatcgacgaccgcttcgccaacgccctcgtcgccctcaacgacatgggcaaggtccgcaaggacatcccccagtggcagccctcccgcggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggagaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12981 - RNA, 9873 nt, synthetic construct
  misc_feature 1..9873: note = derived and/or modified CDS sequence (opt2) from DENV-3__KC762681__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccttccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacgtcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagttcatcgagggcaaggtcgtccagcacgagaacctcaagtacaccgtcatcatcaccgtccacaccggcgaccagcaccaggtcggcaacgagacccagggcgtcaccgccgagatcaccccccaggcctccaccgtcgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaacaagaaggagctcctcgtcaccttcaagaacgcccacgccaagaagcaggaggtcgtcgtcctcggctcccaggagggcgccatgcacaccgccctcaccggcgccaccgagatccagacctccggcggcacctccatcttcgccggccacctcaagtgccgcctcaagatggacaagctcgagctcaagggcatgtcctacgccatgtgcctcaacgccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggacctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgagatgtacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccgtctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccgcaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcgtctccctcatgtgctccaacaccatgttcaccctcaccgtcgcctggcgcaccgccaccctcatcctcgccggcatctccctcctccccgtctgccagtcctcctccatgcgcaagaccgactggctccccgtcaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcatctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgcccacaccggcaaggagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaagaccgaccgcgtcatcgacccccgccgctgcctcaagcccgtcatcctcaccgacggccccgagcgcgtcatcctcgccggccccatgcccgtcaccgtcgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcgtcgcctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccttctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatccgccgcatcaaggaggagcactcctccacctggcactacgacgaggagaacccctacaagacctgggcctaccacggctcctacgaggtcaaggccaccggctccgcctcctccatgatcaacggcgtcgtcaagctcctcaccaagccctgggacgtcgtccccaccgtcacccagatggccatgaccgacaccacccccttcggccagcagcgcgtcttcaaggagaaggtcgacacccgcaccccccgccccatgcccggcacccgcaaggccatggagatcaccgccgagtggctctggcgcaccctcggccgcaacaagcgcccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactccttctccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggtccagctcatccgccagatggagggcgagggcgtcctctccaaggccgacctcgagaacccccacctcctcgagaaggagatcacccagtggctcgagaccaagggcgtcgagcgcctcaagcgcatggccatctccggcgacgactgcgtcgtcaagcccatcgacgaccgcttcgccgacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtgggccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcgcctcccgcgccacctgggcccagaacatcctcaccgccatccagcaggtccgctccctcatcggcaacgaggagttcctcgactacatgccctccatgaagcgcttccgcaaggaggaggagtccgagggcgccatctggtga

SEQ ID NO: 12982 - RNA, 9873 nt, synthetic construct
  misc_feature 1..9873: note = derived and/or modified CDS sequence (opt2) from DENV-3__KC762684__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcgcccagacctggatgtccgccgagggcgcctggcgccaggtcgagaaggtcgagacctgggccttccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacgtcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagctcatcgagggcaaggtcgtccagcacgagaacctcaagtacaccgtctccatcaccgtccacaccggcgaccagcaccaggtcggcaacgagacccagggcgtcaccgccgagatcaccccccaggcctccaccgtcgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaacaagaaggagctcctcgtcaccttcaagaacgcccacgccaagaagcaggaggtcgtcgtcctcggctcccaggagggcgccatgcacaccgccctcaccggcgccaccgagatccagacctccggcggcacctccatcttcgccggccacctcaagtgccgcctcaagatggacaagctcgagctcaagggcatgtcctacgccatgtgctccaacgccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcatcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcatcctcgagcagggcaagcgcaccctcaccccccagcccatggagctcaagtactcctggaagacctggggcaaggccaagatcgtcaccgccgagatgcagaactcctccttcatcatcgacggccccaacacccccgagtgccccaacgcctcccgcgcctggaacgtctgggaggtcgaggactacggcttcggcgtcttcaccaccaacatctggctcaagctccgcgagatgtacacccagctctgcgaccaccgcctcatgtccgccgccatcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagcgcgaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccgcaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcgtcacccagttcgagacctaccagctctggaccgccctcgtctccctcatgtgctccaacaccatcttcaccctcaccgtcgcctggcgcaccgccaccctcatcctcgccggcatctccctcctccccctctgccagtcctccggcatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagacctccgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggcaaggagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgactggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgtcgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgtcatgctcttcctcatctccggcaagggcgtcggcaagacctccatcggcctcatctgcgtcgtcgcctcctcctccatgctctggatggccgacatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccttctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccgccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacctaccgccgccccaccatcgagaaggacgtcgacctcggcgccggcacccgccacgtcaacgccgagcccgagacccccaacatggacgtcatcggcgagcgcatccgccgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccaccgtcacccagatggccatgaccgacaccacccccttcggccagcagcgcgtcttcaaggagaaggtcgacacccgcacccccaagcccatgcccggcacccgcaaggtcatggagatcaccgccgagtggctctggcgcaccctcggccgcaacaagcgcccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcatccgccagatggagggcgagggcgtcctctccaagaccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtgggccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcaacgaggagttcctcgactacatgccctccatgaagcgcttccgcaaggaggaggagtccgagggcgccatctggtga

SEQ ID NO: 12983 - RNA, 9873 nt, synthetic construct
  misc_feature 1..9873: note = derived and/or modified CDS sequence (opt2) from DENV-3__KC762686__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcgcccagacctggatgtccgccgagggcgcctggcgccaggtcgagaaggtcgagacctgggccttccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacgtcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagttcatcgagggcaaggtcgtccagcacgagaacctcaagtacaccgtcatcatcaccgtccacaccggcgaccagcaccaggtcggcaacgagacccagggcgtcaccgccgagatcaccccccaggcctccaccgtcgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaacaagaaggagctcctcgtcaccttcaagaacgcccacgccaagaagcaggaggtcgtcgtcctcggctcccaggagggcgccatgcacaccgccctcaccggcgccaccgagatccagacctccggcggcacctccatcttcgccggccacctcaagtgccgcctcaagatggacaagctcgagctcaagggcatgtcctacgccatgtgcctcaacgccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccatcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccaccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgagatgtacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccgtctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccgcaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcgtctccctcatgtgctccaacaccatcttcaccctcaccgtcgcctggcgcaccgccaccctcatcctcgccggcatctccctcctccccgtctgccagtcctcctccatgcgcaagaccgactggctccccgtcaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcatctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgcccacaccggcaaggagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgtcgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcgtcgcctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccttctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatccgccgcatcaaggaggagcactcctccacctggcactacgacgaggagaacccctacaagacctgggcctaccacggctcctacgaggtcaaggccaccggctccgcctcctccatgatcaacggcgtcgtcaagctcctcaccaagccctgggacgtcgtccccaccgtcacccagatggccatgaccgacaccacccccttcggccagcagcgcgtcttcaaggagaaggtcgacacccgcaccccccgccccatgcccggcacccgcaaggccatggagatcaccgccgagtggctctggcgcaccctcggccgcaacaagcgcccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactccttctccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggagcccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggtccagctcatccgccagatggagggcgagggcgtcctctccaaggccgacctcgagaacccccacctcctcgagaaggagatcacccagtggctcgagaccaagggcgtcgagcgcctcaagcgcatggccatctccggcgacgactgcgtcgtcaagcccatcgacgaccgcttcgccgacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtgggccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcgcctcccgcgccacctgggcccagaacatcctcaccgccatccagcaggtccgctccctcatcggcaacgaggagttcctcgactacatgccctccatgaagcgcttccgcaaggaggaggagtccgagggcgccatctggtga

SEQ ID NO: 12984 - RNA, 9873 nt, synthetic construct
  misc_feature 1..9873: note = derived and/or modified CDS sequence (opt2) from DENV-3__KC762685__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcgcccagacctggatgtccgccgagggcgcctggcgccaggtcgagaaggtcgagacctgggccttccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacgtcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcaccaagttccagtgcctcgagttcatcgagggcaaggtcgtccagcacgagaacctcaagtacaccgtcatcatcaccgtccacaccggcgaccagcaccaggtcggcaacgagacccagggcgtcaccgccgagatcaccccccaggcctccaccgtcgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaacaagaaggagctcctcgtcaccttcaagaacgcccacgccaagaagcaggaggtcgtcgtcctcggctcccaggagggcgccatgcacaccgccctcaccggcgccaccgagatccagacctccggcggcacctccatcttcgccggccacctcaagtgccgcctcaagatggacaagctcgagctcaagggcatgtcctacgccatgtgcctcaacgccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgagatgtacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccgtctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccgcaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcgtctccctcatgtgctccaacaccatcttcaccctcaccgtcgcctggcgcaccgccaccctcatcctcgccggcatctccctcctccccgtctgccagtcctcctccatgcgcaagaccgactggctccccgtcaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcatctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgcccacaccggcaaggagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgtcgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcgtcgcctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccttctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatccgccgcatcaaggaggagcactcctccacctggcactacgacgaggagaacccctacaagacctgggcctaccacggctcctacgaggtcaaggccaccggctccgcctcctccatgatcaacggcgtcgtcaagctcctcaccaagccctgggacgtcgtccccaccgtcacccagatggccatgaccgacaccacccccttcggccagcagcgcgtcttcaaggagaaggtcgacacccgcaccccccgccccatgcccggcacccgcaaggccatggagatcaccgccgagtggctctggcgcaccctcggccgcaacaagcgcccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactccttctccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggagcccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggtccagctcatccgccagatggagggcgagggcgtcctctccaaggccgacctcgagaacccccacctcctcgagaaggagatcacccagtggctcgagaccaagggcgtcgagcgcctcaagcgcatggccatctccggcgacgactgcgtcgtcaagcccatcgacgaccgcttcgccgacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtgggccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcgcctcccgcgccacctgggcccagaacatcctcaccgccatccagcaggtccgctccctcatcggcaacgaggagttcctcgactacatgccctccatgaagcgcttccgcaaggaggaggagtccgagggcgccatctggtga

SEQ ID NO: 12985 - RNA, 9873 nt, synthetic construct
  misc_feature 1..9873: note = derived and/or modified CDS sequence (opt2) from DENV-3__KC762687__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcgcccagacctggatgtccgccgagggcgcctggcgccaggtcgagaaggtcgagacctgggccttccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacgtcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagttcatcgagggcaaggtcgtccagcacgagaacctcaagtacaccgtcatcatcaccgtccacaccggcgaccagcaccaggtcggcaacgagacccagggcgtcaccgccgagatcaccccccaggcctccaccgtcgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaacaagaaggagctcctcgtcaccttcaagaacgcccacgccaagaagcaggaggtcgtcgtcctcggctcccaggagggcgccatgcacaccgccctcaccggcgccaccgagatccagacctccggcggcacctccatcttcgccggccacctcaagtgccgcctcaagatggacaagctcgagctcaagggcatgtcctacgccatgtgcctcaacgccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcgtcaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgagatgtacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccgtctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccgcaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcgtctccctcatgtgctccaacaccatcttcaccctcaccgtcgcctggcgcaccgccaccctcatcctcgccggcatctccctcttccccgtctgccagtcctcctccatgcgcaagaccgactggctccccgtcaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcatctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgtccacaccggcaaggagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgtcgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccacaagacccgctccgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcgtcgcctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccttctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatccgccgcatcaaggaggagcactcctccacctggcactacgacgaggagaacccctacaagacctgggcctaccacggctcctacgaggtcaaggccaccggctccgcctcctccatgatcaacggcgtcgtcaagctcctcaccaagccctgggacgtcgtccccaccgtcacccagatggccatgaccgacaccacccccttcggccagcagcgcgtcttcaaggagaaggtcgacacccgcaccccccgccccatgcccggcacccgcaaggccatggagatcaccgccgagtggctctggcgcaccctcggccgcaacaagcgcccccgcctctgcacccgcgaggagttcaccaagaaggtccgcaccaacgccgccatgggcgccgtcttcaccgaggagaaccagtgggactccgccaaggccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactccttctccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggtccagctcatccgccagatggagggcgagggcgtcctctccaaggccgacctcgagaacccccacctcctcgagaaggagatcacccagtggctcgagaccaagggcgtcgagcgcctcaagcgcatggccatctccggcgacgactgcgtcgtcaagcccatcgacgaccgcttcgccgacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtgggccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcgcctcccgcgccacctgggcccagaacatcctcaccgccatccagcaggtccgctccctcatcggcaacgaggagttcctcgactacatgccctccatgaagcgcttccgcaaggaggaggagtccgagggcgccatctggtga

SEQ ID NO: 12986 - RNA, 9873 nt, synthetic construct
  misc_feature 1..9873: note = derived and/or modified CDS sequence (opt2) from DENV-3__KC762688__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcgcccagacctggatgtccgccgagggcgcctggcgccaggtcgagaaggtcgagacctgggccttccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacgtcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagttcatcgagggcaaggtcgtccagcacgagaacctcaagtacaccgtcatcatcaccgtccacaccggcgaccagcaccaggtcggcaacgagacccagggcgtcaccgccgagatcaccccccaggcctccaccgtcgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaacaagaaggagctcctcgtcaccttcaagaacgcccacgccaagaagcaggaggtcgtcgtcctcggctcccaggagggcgccatgcacaccgccctcaccggcgccaccgagatccagacctccggcggcacctccatcttcgccggccacctcaagtgccgcctcaagatggacaagctcgagctcaagggcatgtcctacgccatgtgcctcaacgccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgagatgtacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccgtctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccgcaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcgtctccctcatgtgctccaacaccctcttcaccctcaccgtcgcctggcgcaccgccaccctcatcctcgccggcatctccctcctccccgtctgccagtcctcctccatgcgcaagaccgactggctccccgtcaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcatctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgcccacaccggcaaggagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgtcgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagttccccgagaccatggagaccctcctcctcctcggcctcatgatcctcctcaccggcggcgccatgctcttcctcatctccggcaagggcatcggcaagacctccatcggcctcatctgcgtcgtcgcctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccttctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagaagggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatccgccgcatcaaggaggagcactcctccacctggcactacgacgaggagaacccctacaagacctgggcctaccacggctcctacgaggtcaaggccaccggctccgcctcctccatgatcaacggcgtcgtcaagctcctcaccaagccctgggacgtcgtccccaccgtcacccagatggccatgaccgacaccacccccttcggccagcagcgcgtcttcaaggagaaggtcgacacccgcaccccccgccccatgcccggcacccgcaaggccatggagatcaccgccgagtggctctggcgcaccctcggccgcaacaagcgcccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactccttctccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggtccagctcatccgccagatggagggcgagggcgtcctctccaaggccgacctcgagaacccccacctcctcgagaaggagatcacccagtggctcgagaccaagggcgtcgagcgcctcaagcgcatggccatctccggcgacgactgcgtcgtcaagcccatcgacgaccgcttcgccgacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtgggccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatcgaggacaagacccccgtcaccacctgggaggacgtcccctacctcggcaagcgcgaggaccagtggtgcggctccctcatcggcctcgcctcccgcgccacctgggcccagaacatcctcaccgccatccagcaggtccgctccctcatcggcaacgaggagttcctcgactacatgccctccatgaagcgcttccgcaaggaggaggagtccgagggcgccatctggtga

SEQ ID NO: 12987 - RNA, 9873 nt, synthetic construct
  misc_feature 1..9873: note = derived and/or modified CDS sequence (opt2) from DENV-3__KC762689__SS-prME
  source 1..9873: mol_type = other RNA
acctccctctgcctcatgatgatgatccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcgcccagacctggatgtccgccgagggcgcctggcgccaggtcgagaaggtcgagacctgggccttccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacgtcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagttcatcgagggcaaggtcgtccagcacgagaacctcaagtacaccgtcatcatcaccgtccacaccggcgaccagcaccaggtcggcaacgagacccagggcgtcaccgccgagatcaccccccaggcctccaccgtcgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaacaagaaggagctcctcgtcaccttcaagaacgcccacgccaagaagcaggaggtcgtcgtcctcggctcccaggagggcgccatgcacaccgccctcaccggcgccaccgagatccagacctccggcggcacctccatcttcgccggccacctcaagtgccgcctcaagatggacaagctcgagctcaagggcatgtcctacgccatgtgcctcaacgccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgagatgtacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccgtctcccagcacaactaccgccccggctaccacacccagaccgccggcccctggcacctcggcaagctcgagctcgacttcaactactgcgagggcaccaccgtcgtcatcaccgagtcctgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccgcaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcgtctccctcatgtgctccaacaccatcttcaccctcaccgtcgcctggcgcaccgccaccctcatcctcgccggcatctccctcctccccgtctgccagtcctcctccatgcgcaagaccgactggctccccgtcaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcatctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcgtcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgacctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgtccacaccggcaaggagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgtcgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcctaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcgtcgcctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaaggtcgacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccttctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatccgccgcatcaaggaggagcactcctccacctggcactacgacgaggagaacccctacaagacctgggcctaccacggctcctacgaggtcaaggccaccggctccgcctcctccatgatcaacggcgtcgtcaagctcctcaccaagccctgggacgtcgtccccaccgtcacccagatggccatgaccgacaccacccccttcggccagcagcgcgtcttcaaggagaaggtcgacacccgcaccccccgccccatgcccggcacccgcaaggccatggagatcaccgccgagtggctctggcgcaccctcggccgcaacaagcgcccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactccttctccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggtccagctcatccgccagatggagggcgagggcgtcctctccaaggccgacctcgagaacccccacctcctcgagaaggagatcacccagtggctcgagaccaagggcgtcgagcgcctcaagcgcatggccatctccggcgacgactgcgtcgtcaagcccatcgacgaccgcttcgccgacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtgggccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcgcctcccgcgccacctgggcccagaacatcctcaccgccatccagcaggtccgctccctcatcggcaacgaggagttcctcgactacatgccctccatgaagcgcttccgcaaggaggaggagtccgagggcgccatctggtga

SEQ ID NO: 12988 - RNA, 9873 nt, synthetic construct
  misc_feature 1..9873: note = derived and/or modified CDS sequence (opt2) from DENV-3__KC762690__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcgcccagacctggatgtccgccgagggcgcctggcgccaggtcgagaaggtcgagacctgggccttccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacgtcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagttcatcgagggcaaggtcgtccagcacgagaacctcaagtacaccgtcatcatcaccgtccacaccggcgaccagcaccaggtcggcaacgagacccagggcgtcaccgccgagatcaccccccaggcctccaccgtcgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaacaagaaggagctcctcgtcaccttcaagaacgcccacgccaagaagcaggaggtcgtcgtcctcggctcccaggagggcgccatgcacaccgccctcaccggcgccaccgagatccagacctccggcggcacctccatcttcgccggccacctcaagtgccgcctcaagatggacaagctcgagctcaagggcatgtcctacgccatgtgcctcaacgccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgagatgtacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccgtctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccgcaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcgtctccctcatgtgctccaacaccatcttcaccctcaccgtcgcctggcgcaccgccaccctcatcctcgccggcatctccctcctccccgtctgccagtcctcctccatgcgcaagaccgactggctccccgtcaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcatctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgcccacaccggcaaggagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgtcgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcgtcgcctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccttctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatccgccgcatcaaggaggagcactcctccacctggcactacgacgaggagaacccctacaagacctgggcctaccacggctcctacgaggtcaaggccaccggctccgcctcctccatgatcaacggcgtcgtcaagctcctcaccaagccctgggacgtcgtccccaccgtcacccagatggccatgaccgacaccacccccttcggccagcagcgcgtcttcaaggagaaggtcgacacccgcaccccccgccccatgcccggcacccgcaaggccatggagatcaccgccgagtggctctggcgcaccctcggccgcaacaagcgcccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactccttctccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggagcccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggtccagctcatccgccagatggagggcgagggcgtcctctccaaggccgacctcgagaacccccacctcctcgagaaggagatcacccagtggctcgagaccaagggcgtcgagcgcctcaagcgcatggccatctccggcgacgactgcgtcgtcaagcccatcgacgaccgcttcgccgacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtgggccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcgcctcccgcgccacctgggcccagaacatcctcaccgccatccagcaggtccgctccctcatcggcaacgaggagttcctcgactacatgccctccatgaagcgcttccgcaaggaggaggagtccgagggcgccatctggtga

SEQ ID NO: 12989 - RNA, 9873 nt, synthetic construct
  misc_feature 1..9873: note = derived and/or modified CDS sequence (opt2) from DENV-3__KC762691__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcgcccagacctggatgtccgccgagggcgcctggcgccaggtcgagaaggtcgagacctgggccttccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacgtcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagctcatcgagggcaaggtcgtccagcacgagaacctcaagtacaccgtcatcatcaccgtccacaccggcgaccagcaccaggtcggcaacgagacccagggcgtcaccgccgagatcaccccccaggcctccaccgtcgaggccatcctccccgagtacggcaccctcggcctcgagtgctccccccgcaccggcctcgacttcaacgagatgatcctcctcaccatgaaggacaaggcctggatggtccaccgccagtggttcttcgacctccccctcccctggacctccggcgccaccaccgagacccccacctggaacaagaaggagctcctcgtcaccttcaagaacgcccacgccaagaagcaggaggtcgtcgtcctcggctcccaggagggcgccatgcacaccgccctcaccggcgccaccgagatccagacctccggcggcacctccatcttcgccggccacctcaagtgccgcctcaagatggacaagctcgagctcaagggcatgtcctacaccatgtgctccaacgccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcatcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactccccccgccgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacaccatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgccccaacgcctcccgcgcctggaacgtctgggaggtcgaggactacggcttcggcgtcttcaccaccaacatctggctcaagctccgcgagatgtacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcgcccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccgcaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcgtctccctcatgtgctccaacaccatcttcaccctcaccgtcgcctggcgcaccgccaccctcatcctcgccggcatctccctcttccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggcaaggagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgactggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgtcgcctccgccgcccagcgccgcggccgcatcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcgtcggcaagacctccatcggcctcatctgcgtcgtcgcctcctccggcatgctctggatggccgacatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccttctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacctaccgccgccccaccatcgagaaggacgtcgacctcggcgccggcacccgccacgtcaacgccgagcccgagacccccaacatggacgtcatcggcgagcgcatccgccgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccaccgtcacccagatggccatgaccgacaccacccccttcggccagcagcgcgtcttcaaggagaaggtcgacacccgcacccccaagcccatgcccggcacccgcaaggtcatggagatcaccgccgagtggctctggcgcaccctcggccgcaacaagcgcccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcatccgccagatggagggcgagggcgtcctctccaagaccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtgggccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcaacgaggagttcctcgactacatgccctccatgaagcgcttccgcaaggaggaggagtccgagggcgccatctggtga

SEQ ID NO: 12990 - RNA, 9873 nt, synthetic construct
  misc_feature 1..9873: note = derived and/or modified CDS sequence (opt2) from DENV-3__KC762692__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcgcccagacctggatgtccgccgagggcgcctggcgccaggtcgagaaggtcgagacctgggccttccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacgtcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagctcatcgagggcaaggtcgtccagcacgagaacctcaagtacaccgtcatcatcaccgtccacaccggcgaccagcaccaggtcggcaacgagacccagggcgtcaccgccgagatcaccccccaggcctccaccgtcgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaacaagaaggagctcctcgtcaccttcaagaacgcccacgccaagaagcaggaggtcgtcgtcctcggctcccaggagggcgccatgcacaccgccctcaccggcgccaccgagatccagacctccggcggcacctccatcttcgccggccacctcaagtgccgcctcaagatggacaagctcgagctcaagggcatgtcctacgccatgtgctccaacgccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcatcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgtcggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagatccagaactcctccttcatcatcgacggccccaacacccccgagtgccccaacgcctcccgcgcctggaacgtctgggaggtcgaggactacggcttcggcgtcttcaccaccaacatctggctcaagctccgcgagatgtacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcatgttcgtcctcctcctctccggccagatcacctggcgcgacatggcccgcaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggtcctcaagctcatcacccagttcgagacctaccagctctggaccgccctcgtctccctcacctgctccaacaccatcttcaccctcaccgtcgcctggcgcaccgccaccctcatcctcgccggcacctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccatcaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccaccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggcaaggagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgactggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgtcgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcgtcggcaagacctccatcggcctcatctgcgtcgtcgcctcctccggcatgctctggatggccgacatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccttctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacctaccgccgccccaccatcgagaaggacgtcgacctcggcgccggcacccgccacgtcaacgccgagcccgagacccccaacatggacgtcatcggcgagcgcatccgccgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccaccgtcacccagatggccatgaccgacaccacccccttcggccagcagcgcgtcttcaaggagaaggtcgacacccgcacccccaagcccatgcccggcacccgcaagatcatggagatcaccgccggctggctctggcgcaccctcggccgcaacaagcgcccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagcagggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcatccgccagatggagggcgagggcgtcctctccaagaccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaacctcgtcgtcccctgccgcccccaggacgagctcatcggccgcgcccgcatctcccagggcgccggctggtccctcaaggagaccgcctgcctcggcaaggcctacgcccagatgtgggccctcatgtacttccaccgccgcgacctccgcctcgcctccaacgccatctgctccgccgtccccgtccactgggtccccacctcccgcaccacctggtccatccacgcccaccaccagtggatgaccaccgagaacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcaacgaggagttcctcgactacatgccctccatgaagcgcttccgcaaggaggaggagtccgagggcgccatctggtga

SEQ ID NO: 12991 - RNA, 9873 nt, synthetic construct
  misc_feature 1..9873: note = derived and/or modified CDS sequence (opt2) from DENV-3__JQ920481__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccttccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacgtcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagtccatcgagggcaaggccgtccagcacgagaacctcaagtacaccgtcatcatcaccgtccacaccggcgaccagcaccaggtcggcaacgagacccagggcgtcaccgccgagatcaccccccaggcctccaccgtcgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaacaagaaggagctcctcgtcaccttcaagaacgcccacgccaagaagcaggaggtcgtcgtcctcggctcccaggagggcgccatgcacaccgccctcaccggcgccaccgagatccagacctccggcggcacctccatcttcgccggccacctcaagtgccgcctcaagatggacaagctcgagctcaagggcatgtcctacgccatgtgcctcaacgccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccatcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacgtcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgagatgtacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggccgacaacttcaccatgggcgtcctctgcctcgccatcctcttcgaggaggtcatgcgcggcaagttcggcaagaagcacatgatcgccggcgccctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcgtctccctcatgtgctccaacaccatcttcaccctcaccgtcgcctggcgcaccgccaccctcatcctcgccgtcatctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccttcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggccaacgtcaagaaggacctcatctcctacggcggcggctggaagctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcgtcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgtcgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcgtcgcctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccttctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatccgccgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagcgcccccgcctctgcacccgcgaggagttcatcaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctcctcgagaagaaggtcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtgggccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcaacgaggagttcctcgactacatgccctccatgaagcgcttccgcaaggaggaggagtccgagggcgccatctggtga

SEQ ID NO: 12992 - RNA, 9873 nt, synthetic construct
  misc_feature 1..9873: note = derived and/or modified CDS sequence (opt2) from DENV-3__JQ920483__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccttccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacgtcaccaccgactcccgctgccccacccagggcgaggccatcctccccgaggagcagaaccagaactacgtctgcaagcacacctacgtcgaccgcggctggggcaacggctgcggcctcttcggcaagggctccctcgtcacctgcgccaagttccagtgcctcgagtccatcgagggcaaggccgtccagcacgagaacctcaagtacaccgtcatcatcaccgtccacaccggcgaccagcaccaggtcggcaacgagacccagggcgtcaccgccgagatcaccccccaggcctccaccgtcgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaacaagaaggagctcctcgtcaccttcaagaacgcccacgccaagaagcaggaggtcgtcgtcctcggctcccaggagggcgccatgcacaccgccctcaccggcgccaccgagatccagacctccggcggcacctccatcttcgccggccacctcaagtgccgcctcaagatggacaagctcgagctcaagggcatgtcctacgccatgtgcctcaacgccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccatcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccatcgtcgtcggcgacgtcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgagaagtacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcatccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaagaccgacaacttcaccatgggcgtcctctgcctcgccatcctcttcgaggaggtcatgcgcggcaagttcggcaagaagcacatgatcgccggcgccctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcatgtgctccaacaccatcttcaccctcaccgtcgcctggcgcaccgccaccctcatcctcgccgtcatctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccttcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggccaacgtcaagaaggacctcatctcctacggcggcggctggaagctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcgtcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgtcgcctccgccgcccagcgccgcggccgcgtcggccgcaactcccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcgtcgcctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccttctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatccgccgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagcgcccccgcctctgcacccgcgaggagttcatcaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcccactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctcctcgagcgcaaggtcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtgggccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcaacgaggagttcctcgactacatgccctccatgaagcgcttccgcaaggaggaggagtccgagggcgccatctggtga

SEQ ID NO: 12993 - RNA, 9873 nt, synthetic construct
  misc_feature 1..9873: note = derived and/or modified CDS sequence (opt2) from DENV-3__JQ920482__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccttccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacgtcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagtccatcgagggcaaggccgtccagcacgagaacctcaagtacaccgtcatcatcaccgtccacaccggcgaccagcaccaggtcggcaacgagacccagggcgtcaccgccgagatcaccccccaggcctccaccgtcgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaacaagaaggagctcctcgtcaccttcaagaacgcccacgccaagaagcaggaggtcgtcgtcctcggctcccaggagggcgccatgcacaccgccctcaccggcgccaccgagatccagacctccggcggcacctccatcttcgccggccacctcaagtgccgcctcaagatggacaagctcgagctcaagggcatgtcctacgccatgtgcctcaacgccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccatcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccatcgtcgtcggcgacgtcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgagaagtacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcatccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaagaccgacaacttcaccatgggcgtcctctgcctcgccatcctcttcgaggaggtcatgcgcggcaagttcggcaagaagcacatgatcgccggcgccctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcatgtgctccaacaccatcttcaccctcaccgtcgcctggcgcaccgccaccctcatcctcgccgtcatctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccttcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggccaacgtcaagaaggacctcatctcctacggcggcggctggaagctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcgtcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgtcgcctccgccgcccagcgccgcggccgcgtcggccgcaactcccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcgtcgcctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccttctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatccgccgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagcgcccccgcctctgcacccgcgaggagttcatcaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcccactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctcctcgagaagaaggtcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtgggccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcaacgaggagttcctcgactacatgccctccatgaagcgcttccgcaaggaggaggagtccgagggcgccatctggtga

SEQ ID NO: 12994 - RNA, 9873 nt, synthetic construct
  misc_feature 1..9873: note = derived and/or modified CDS sequence (opt2) from DENV-3__JQ920484__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccttccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacgtcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagtccatcgagggcaaggccgtccagcacgagaacctcaagtacaccgtcatcatcaccgtccacaccggcgaccagcaccaggtcggcaacgagacccagggcgtcaccgccgagatcaccccccaggcctccaccgtcgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaacaagaaggagctcctcgtcaccttcaagaacgcccacgccaagaagcaggaggtcgtcgtcctcggctcccaggagggcgccatgcacaccgccctcaccggcgccaccgagatccagacctccggcggcacctccatcttcgccggccacctcaagtgccgcctcaagatggacaagctcgagctcaagggcatgtcctacgccatgtgcctcaacgccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccatcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccatcgtcgtcggcgacgccatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgagaagtacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcatccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaagaccgacaacttcaccatgggcgtcctctgcctcgccatcctcttcgaggaggtcatgcgcggcaagttcggcaagaagcacatgatcgccggcgccctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcatgtgctccaacaccatcttcaccctcaccgtcgcctggcgcaccgccaccctcatcctcgccgtcatctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccttcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggccaacgtcaagaaggacctcatctcctacggcggcggctggaagctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcgtcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgtcgcctccgccgcccagcgccgcggccgcgtcggccgcaactcccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcgtcgcctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccttctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatccgccgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagcgcccccgcctctgcacccgcgaggagttcatcaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcccactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctcctcgagaagaaggtcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtgggccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcaacgaggagttcctcgactacatgccctccatgaagcgcttccgcaaggaggaggagtccgagggcgccatctggtga

SEQ ID NO: 12995 - RNA, 9873 nt, synthetic construct
  misc_feature 1..9873: note = derived and/or modified CDS sequence (opt2) from DENV-3__JQ920486__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccttccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacgtcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagtccatcgagggcaaggccgtccagcacgagaacctcaagtacaccgtcatcatcaccgtccacaccggcgaccagcaccaggtcggcaacgagacccagggcgtcaccgccgagatcaccccccaggcctccaccgtcgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaacaagaaggagctcctcgtcaccttcaagaacgcccacgccaagaagcaggaggtcgtcgtcctcggctcccaggagggcgccatgcacaccgccctcaccggcgccaccgagatccagacctccggcggcacctccatcttcgccggccacctcaagtgccgcctcaagatggacaagctcgagctcaagggcatgtcctacgccatgtgcctcaacgccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccatcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccatcgtcgtcggcgacgccatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgagaagtacacccagctctgcgaccaccgcctcatgtccgccgccgtcaaggacgagcgcgccgtccacgtcgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcatccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaagaccgacaacttcaccatgggcgtcctctgcctcgccatcctcttcgaggaggtcatgcgcggcaagttcggcaagaagcacatgatcgccggcgccctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcatgtgctccaacaccatcttcaccctcaccgtcgcctggcgcaccgccaccctcatcctcgccgtcatctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccttcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggccaacgtcaagaaggacctcatctcctacggcggcggctggaagctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcgtcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgtcgcctccgccgcccagcgccgcggccgcgtcggccgcaactcccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcgtcgcctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccttctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcatcgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatccgccgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagcgcccccgcctctgcacccgcgaggagttcatcaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcccactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctcctcgagaagaaggtcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtgggccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcaacgaggagttcctcgactacatgccctccatgaagcgcttccgcaaggaggaggagtccgagggcgccatctggtga

SEQ ID NO: 12996 - RNA, 9873 nt, synthetic construct
  misc_feature 1..9873: note = derived and/or modified CDS sequence (opt2) from DENV-3__JQ920485__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccttccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagtccatcgagggcaaggccgtccagcacgagaacctcaagtacaccgtcatcatcaccgtccacaccggcgaccagcaccaggtcggcaacgagacccagggcgtcaccgccgagatcaccccccaggcctccaccgtcgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaacaagaaggagctcctcgtcaccttcaagaacgcccacgccaagaagcaggaggtcgtcgtcctcggctcccaggagggcgccatgcacaccgccctcaccggcgccaccgagatccagacctccggcggcacctccatcttcgccggccacctcaagtgccgcctcaagatggacaagctcgagctcaagggcatgtcctacgccatgtgcctcaacgccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccatcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccatcgtcgtcggcgacgtcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgagaagcacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcatccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaagaccgacaacttcaccatgggcgtcctctgcctcgccatcctcttcgaggaggtcatgcgcggcaagttcggcaagaagcacatgatcgccggcgccctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcatgtgctccaacaccatcttcaccctcaccgtcgcctggcgcaccgccaccctcatcctcgccgtcatctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccttcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggccaacgtcaagaaggacctcatctcctacggcggcggctggaagctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccatccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcgtcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgtcgcctccgccgcccagcgccgcggccgcgtcggccgcaactcccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcgtcgcctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccttctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcatcgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatgaacgtcatcggcgagcgcatccgccgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagcgcccccgcctctgcacccgcgaggagttcatcaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcccactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctcctcgagaagaaggtcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtgggccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcaacgaggagttcctcgactacatgccctccatgaagcgcttccgcaaggaggaggagcccgagggcgccatctggtga

SEQ ID NO: 12997 - RNA, 9873 nt, synthetic construct
  misc_feature 1..9873: note = derived and/or modified CDS sequence (opt2) from DENV-3__FJ644564__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacaccatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagatgtgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcgagaacctcgagctcgacttcacctactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcatcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcctcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgtccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatcaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggctcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccgccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagcgcccccgcctctgcacccgcgaggagttcaccaagaaggtccgcaccaacgccgccatgggcgccgtcttcaccgaggagaaccagtgggactccgccaaggccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggctcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgcctcctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12998 - RNA, 9873 nt, synthetic construct
  misc_feature 1..9873: note = derived and/or modified CDS sequence (opt2) from DENV-3__HQ235027__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccatcgagatccagaactccggcggcacctccatcttcgccggccacctcaagtgccgcctcaagatggacaagctcgagctcaagggcatgtcctacgccatgtgcaccaagaccttcgtcctcaagaaggaggtctccgagacccagcacggcaccatcctcatcaaggtcgagtacaagggcgaggacgccccctgcaagatccccttctccaccgaggacggccagggcaaggcctacaacggccgcctcatcaccgccaaccccgtcgtcaccaagaaggacgagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacatctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacaccatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatgttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcgtcgtctccggcgtcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgaccgctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaagatcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12999 - RNA, 9873 nt, synthetic construct
  misc_feature 1..9873: note = derived and/or modified CDS sequence (opt2) from DENV-3__JQ920476__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccttccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacgtcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagtccatcgagggcaaggccgtccagcacgagaacctcaagtacaccgtcatcatcaccgtccacaccggcgaccagcaccaggtcggcaacgagacccagggcgtcaccgccgagatcaccccccaggcctccaccgtcgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaacaagaaggagctcctcgtcaccttcaagaacgcccacgccaagaagcaggaggtcgtcgtcctcggctcccaggagggcgccatgcacaccgccctcaccggcgccaccgagatccagacctccggcggcacctccatcttcgccggccacctcaagtgccgcctcaagatggacaagctcgagctcaagggcatgtcctacgccatgtgcctcaacgccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccatcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccatcgtcgtcggcgacgtcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgccccaacgcctcccgcgcctggaacgtctgggaggtcgaggactacggcttcggcgtcttcaccaccaacatctggctcaagctccgcgagatgtacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggccgacaacttcaccatgggcgtcctctgcctcgccatcctcttcgaggaggtcatgcgcggcaagttcggcaagaagcacatgatcgccggcgccctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcgtctccctcatgtgctccaacaccatcttcaccctcaccgtcgcctggcgcaccgccaccctcatcctcgccgtcatctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccttcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggccaacgtcaagaaggacctcatctcctacggcggcggctggaagctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcgtcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgtcgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcgtcgcctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagtccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccttctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatccgccgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagcgcccccgcctctgcacccgcgaggagttcatcaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcccactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctcctcgagaagaaggtcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtgggccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcaacgaggagttcctcgactacatgccctccatgaagcgcttccgcaaggaggaggagtccgagggcgccatctggtga

SEQ ID NO: 13000 - RNA, 9873 nt, synthetic construct
  misc_feature 1..9873: note = derived and/or modified CDS sequence (opt2) from DENV-3__JQ920477__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccttccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacgtcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagtccatcgagggcaaggccgtccagcacgagaacctcaagtacaccgtcatcatcaccgtccacaccggcgaccagcaccaggtcggcaacgagacccagggcgtcaccgccgagatcaccccccaggcctccaccgtcgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaacaagaaggagctcctcgtcaccttcaagaacgcccacgccaagaagcaggaggtcgtcgtcctcggctcccaggagggcgccatgcacaccgccctcaccggcgccaccgagatccagacctccggcggcacctccatcttcgccggccacctcaagtgccgcctcaagatggacaagctcgagctcaagggcatgtcctacgccatgtgcctcaacgccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccatcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccatcgtcgtcggcgacgtcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgccctccgcgcctggaacgtctgggaggtcgaggactacggcttcggcgtcttcaccaccaacatctggctcaagctccgcgagaagtacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaagaccgacaacttcaccatgggcgtcctctgcctcgccatcctcttcgaggaggtcatgcgcggcaagttcggcaagaagcacatgatcgccggcgccctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcgtctccctcatgtgctccaacaccatcttcaccctcaccgtcgcctggcgcaccgccaccctcatcctcgccgtcatctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccttcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggccaacgtcaagaaggacctcatctcctacggcggcggctggaagctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcgtcatggacgaggcccacttcaccgaccccgcctccatcgccgcccgcggctacatctccacccgcgtcggcatgggcgaggccgccgccatctccatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgtcgcctccgccgcccagcgccgcggccgcgtcggccgcaactcccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcgtcgcctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccttctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatccgccgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagcgcccccgcctctgcacccgcgaggagttcatcaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcccactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctcctcgagaagaaggtcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtgggccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcaacgaggagttcctcgactacatgccctccatgaagcgcttccgcaaggaggaggagtccgagggcgccatctggtga

SEQ ID NO: 13001 - RNA, 9873 nt, synthetic construct
  misc_feature 1..9873: note = derived and/or modified CDS sequence (opt2) from DENV-3__JQ920478__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccttccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacgtcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagtccatcgagggcaaggccgtccagcacgagaacctcaagtacaccgtcatcatcaccgtccacaccggcgaccagcaccaggtcggcaacgagacccagggcgtcaccgccgagatcaccccccaggcctccaccgtcgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaacaagaaggagctcctcgtcaccttcaagaacgcccacgccaagaagcaggaggtcgtcgtcctcggctcccaggagggcgccatgcacaccgccctcaccggcgccaccgagatccagacctcccgcggcacctccatcttcgccggccacctcaagtgccgcctcaagatggacaagctcgagctcaagggcatgtcctacgccatgtgcctcaacgccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccatcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccatcgtcgtcggcgacgtcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgccctccgcgcctggaacgtctgggaggtcgaggactacggcttcggcgtcttcaccaccaacatctggctcaagctccgcgagaagtacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaagaccgacaacttcaccatgggcgtcctctgcctcgccatcctcttcgaggaggtcatgcgcggcaagttcggcaagaagcacatgatcgccggcgccctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcatgtgctccaacaccatcttcaccctcaccgtcgcctggcgcaccgccaccctcatcctcgccgtcatctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccttcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggccaacgtcaagaaggacctcatctcctacggcggcggctggaagctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcgtcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgtcgcctccgccgcccagcgccgcggccgcgtcggccgcaactcccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcgtcgcctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccttctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatccgccgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacctcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagcgcccccgcctctgcacccgcgaggagttcatcaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcccactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctcctcgagaagaaggtcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtgggccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcaacgaggagttcctcgactacatgccctccatgaagcgcttccgcaaggaggaggagtccgagggcgccatctggtga

SEQ ID NO: 13002 - RNA, 9873 nt, synthetic construct
  misc_feature 1..9873: note = derived and/or modified CDS sequence (opt2) from DENV-3__JQ920480__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccttccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacgtcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagtccatcgagggcaaggccgtccagcacgagaacctcaagtacaccgtcatcatcaccgtccacaccggcgaccagcaccaggtcggcaacgagacccagggcgtcaccgccgagatcaccccccaggcctccaccgtcgaggccatcctccccgactacggcaccctcggcctcgagtgctccccccgcaccggcctcgacttcaacgagatgatcctcctcaccatgaagaacaaggcctggatggtccaccgccagtggttcctcgacctccccctcccctggacctccggcgccaccaccgagacccccacctggaacaagaaggagctcctcgtcaccttcaagaacgcccacgccaagaagcaggaggtcgtcgtcctcggctcccaggagggcgccatgcacaccgccctcaccggcgccaccgagatccagacctccggcggcacctccatcttcgccggccacctcaagtgccgcctcaagatggacaagctcgagctcaagggcatgtcctacgccatgtgcctcaacgccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccatcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccatcgtcgtcggcgacgtcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgccctccgcgcctggaacgtctgggaggtcgaggactacggcttcggcgtcttcaccaccaacatctggctcaagctccgcgagaagtacacccagctctgcgaccaccgcctcatgtccgccgccgtcaaggacgagcgcgccgtccacgccgacatgggctactggatcgagtcccagaagaacgagtcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaagaccgacaacttcaccatgggcgtcctctgcctcgccatcctcttcgaggaggtcatgcgcggcaagttcggcaagaagcacatgatcgccggcgccctcttcatgttcgtcctcctcctctccggccagatcacctggcgcgacatggtccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcatgtgctccaacaccatcttcaccctcaccgtcgcctggcgcaccgccaccctcatcctcgccgtcatctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccttcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggccaacgtcaagaaggacctcatctcctacggcggcggctggaagctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcgtcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgtcgcctccgccgcccagcgccgcggccgcgtcggccgcaactcccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcgtcgcctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccttctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatccgccgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagcgcccccgcctctgcacccgcgaggagttcatcaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcccactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctcctcgagaagaaggtcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtgggccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcaacgaggagttcctcgactacatgccctccatgaagcgcttccgcaaggaggaggagtccgagggcgccatctggtga

SEQ ID NO: 13003 - RNA, 9873 nt, synthetic construct
  misc_feature 1..9873: note = derived and/or modified CDS sequence (opt2) from DENV-3__JQ920479__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccttccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacgtcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagtccatcgagggcaaggccgtccagcacgagaacctcaagtacaccgtcatcatcaccgtccacaccggcgaccagcaccaggtcggcaacgagacccagggcgtcaccgccgagatcaccccccaggcctccaccgtcgaggccatcctccccgagtacggcaccctcggcctcgagtgctccccccgcaccggcctcgacttcaacgagatgatcctcctcaccatgaagaacaaggcctggatggtccaccgccagtggttcctcgacctccccctcccctggacctccggcgccaccaccgagacccccacctggaacaagaaggagctcctcgtcaccttcaagaacgcccacgccaagaagcaggaggtcgtcgtcctcggctcccaggagggcgccatgcacaccgccctcaccggcgccaccgagatccagacctccggcggcacctccatcttcgccggccacctcaagtgccgcctcaagatggacaagctcgagctcaagggcatgtcctacgccatgtgcctcaacgccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccatcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccatcgtcgtcggcgacgtcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgccctccgcgcctggaacgtctgggaggtcgaggactacggcttcggcgtcttcaccaccaacatctggctcaagctccgcgagaagtacacccagctctgcgaccaccgcctcatgtccgccgccgtcaaggacgagcgcgccgtccacgccgacatgggctactggatcgagtcccagaagaacgagtcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcatccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaagaccgacaacttcaccatgggcgtcctctgcctcgccatcctcttcgaggaggtcatgcgcggcaagttcggcaagaagcacatgatcgccggcgccctcttcatgttcgtcctcctcctctccggccagatcacctggcgcgacatggtccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcatgtgctccaacaccatcttcaccctcaccgtcgcctggcgcaccgccaccctcatcctcgccgtcatctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccttcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggccaacgtcaagaaggacctcatctcctacggcggcggctggaagctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcgtcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgtcgcctccgccgcccagcgccgcggccgcgtcggccgcaactcccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcgtcgcctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccttctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactccgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatccgccgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagcgcccccgcctctgcacccgcgaggagttcatcaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcccactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctcctcgagaagaaggtcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtgggccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcaacgaggagttcctcgactacatgccctccatgaagcgcttccgcaaggaggaggagtccgagggcgccatctggtga

SEQ ID NO: 13004 - RNA, 9873 nt, synthetic construct
  misc_feature 1..9873: note = derived and/or modified CDS sequence (opt2) from DENV-3__KU216208__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctggatcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacgcctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcgtcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacaccatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagatgtgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcctcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgagaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcctacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatcaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatggccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccgccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagcgcccccgcctctgcacccgcgaggagttcaccaagaaggtccgcaccaacgccgccatgggcgccgtcttcaccgaggagaaccagtgggactccgccaaggccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgcctcctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 13005 - RNA, 9873 nt, synthetic construct
  misc_feature 1..9873: note = derived and/or modified CDS sequence (opt2) from DENV-3__GU370053__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctgggcctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacaccatcggcgtcctcgagcagggcaagcgcaccctcaccccccagcccatggagctcaagtactcctggaagacctggggcaaggccaagatcgtcaccgccgagatccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagtcctgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctctacgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcgtcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgaggtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcgtccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagcgcccccgcctctgcacccgcgaggagttcaccaagaaggtccgcaccaacgccgccatgggcgccgtcttcaccgaggagaaccagtgggactccgccaaggccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcatccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcgtccgccagatggagggcgagggcgtcctcaccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctcccgcggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggagaacccctggatggaggacaagacccccgtcaccacctgggagaacgtcccctacctcggcaagcgcgaggaccagtggtgcggctccctcatcggcctcacctcccgcgccacctgggcccagaacatcctcaccgccatccagcaggtccgctccctcatcggcaacgaggagttcctcgactacatgccctccatgaagcgcttccgcaaggaggaggagtccgagggcgccatctggtga

SEQ ID NO: 13006 - RNA, 9873 nt, synthetic construct
  misc_feature 1..9873: note = derived and/or modified CDS sequence (opt2) from DENV-3__JQ411814__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcatcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacaccatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgacgtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcgtctccctcacctgctccaacaccatcctcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcctcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatgggcatcaccgccgagtggctctggcgcaccctcggccgcaacaagcgcccccgcctctgcacccgcgaggagttcaccaagaaggtccgcaccaacgccgccatgggcgccgtcttcaccgaggagaaccagtgggactccgccaaggccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgacaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggtccagctcgtccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 13007 - RNA, 9873 nt, synthetic construct
  misc_feature 1..9873: note = derived and/or modified CDS sequence (opt2) from DENV-3__KM190937__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccatcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagtccatcgagggcaaggtcgtccagcacgagaacctcaagtacaccgtcatcatcaccgtccacaccggcgaccagcaccaggtcggcaacgagatgcagggcgtcaccgccgagatcaccccccaggcctccaccgccgaggtcatcctccccgagtacggcaccctcggcctcgagtgctccccccgcaccggcctcgacttcaacgagatgatctccctcaccatgaagaacaaggcctggatggtccaccgccagtggttcttcgacctccccctcccctggacctccggcgccaccgccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagacctccggcggcacctccatcttcgccggccacctcaagtgccgcctcaagatggacaagctcgagctcaagggcatgtcctacgccatgtgcctctcctccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttcggcggcgtctcctggatgatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcaccggcgtcctcgagcagggcaagcgcaccctcaccccccagcccatggagctcaagtactcctggaagacctggggcaaggccaagatcgtcaccgccgagacccagaactcctccttcatcatcgacggcccctccacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatctccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgcctccgccggctccggcaaggtcgacaacttcaccatgggcgtcctctgcctcgccatcctcttcgaggaggtcatgcgcggcaagttcggcaagatccacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccgccaccctccgcctccccgaggacatcgagcagatggccaacggcatcgccctcggcctcatggccctcaagctcatcacccagttcgagacctaccagctctggaccgccctcgtctccctcacctgctccaacaccatcttcaccctcaccgtcgcctggcgcaccgccaccctcatcctcgccggcatctccctcctccccgtctgccagtcctcctccatgcgcaagaccgactggctccccatgaccgtcgccgccatgggcgcccagcccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatggtcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgtcgcctccgccgcccagcgccgcggccgcgtcggccgcaacccccagaaggagaacgaccagtacatcttcatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcgccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggtcctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagcgcccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccaccccctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtgggccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcaacgaggagttcctcgactacatgccctccatgaagcgcttccgcaaggaggaggagtccgagggcgccatctggtga

SEQ ID NO: 13008 - RNA, 9873 nt, synthetic construct
  misc_feature 1..9873: note = derived and/or modified CDS sequence (opt2) from DENV-3__JQ920487__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccttccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacgtcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagtccatcgagggcaaggccgtccagcacgagaacctcaagtacaccgtcatcatcaccgtccacaccggcgaccagcaccaggtcggcaacgagacccagggcgtcaccgccgagatcaccccccaggcctccaccgtcgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaacaagaaggagctcctcgtcaccttcaagaacgcccacgccaagaagcaggaggtcgtcgtcctcggctcccaggagggcgccatgcacaccgccctcaccggcgccaccgagatccagacctccggcggcacctccatcttcgccggccacctcaagtgccgcctcaagatggacaagctcgagctcaagggcatgtcctacgccatgtgcctcaacgccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccatcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacgtcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgagatgtacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggccgacaacttcaccatgggcgtcctctgcctcgccatcctcttcgaggaggtcatgcgcggcaagttcggcaagaagcacatgatcgccggcgccctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcgtctccctcatgtgctccaacaccatcttcaccctcaccgtcgcctggcgcaccgccaccctcatcctcgccgtcatctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccttcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggccaacgtcaagaaggacctcatctcctacggcggcggctggaagctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcgtcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgtcgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcgtcgcctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccttctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatccgccgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagcgcccccgcctctgcacccgcgaggagttcatcaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcccactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctcctcgagaagaaggtcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtgggccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcaacgaggagttcctcgactacatgccctccatgaagcgcttccgcaaggaggaggagtccgagggcgccatctggtga

SEQ ID NO: 13009 - RNA, 9873 nt, synthetic construct
  misc_feature 1..9873: note = derived and/or modified CDS sequence (opt2) from DENV-3__JQ920488__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccttccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacgtcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagtccatcgagggcaaggccgtccagcacgagaacctcaagtacaccgtcatcatcaccgtccacaccggcgaccagcaccaggtcggcaacgagacccagggcgtcaccgccgagatcaccccccaggcctccaccgtcgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaacaagaaggagctcctcgtcaccttcaagaacgcccacgccaagaagcaggaggtcgtcgtcctcggctcccaggagggcgccatgcacaccgccctcaccggcgccaccgagatccagacctccggcggcacctccatcttcgccggccacctcaagtgccgcctcaagatggacaagctcgagctcaagggcatgtcctacgccatgtgcctcaacgccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccatcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccatcgtcgtcggcgacgtcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgccctccgcgcctggaacgtctgggaggtcgaggactacggcttcggcgtcttcaccaccaacatctggctcaagctccgcgagaagtacacccagctctgcgaccaccgcctcatgtccgccgccgtcaaggacgagcgcgccgtccacgccgacatgggctactggatcgagtcccagaagaacgagtcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcatccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaagaccgacaacttcaccatgggcgtcctctgcctcgccatcctcttcgaggaggtcatgcgcggcaagttcggcaagaagcacatgatcgccggcgccctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcatgtgctccaacaccatcttcaccctcaccgtcgcctggcgcaccgccaccctcatcctcgccgtcatctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccttcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggccaacgtcaagaaggacctcatctcctacggcggcggctggaagctcggcgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcgtcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgtcgcctccgccgcccagcgccgcggccgcgtcggccgcaactcccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcgtcgcctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccttctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatccgccgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagcgcccccgcctctgcacccgcgaggagttcatcaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcccactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctcctcgagaagaaggtcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtgggccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcaacgaggagttcctcgactacatgccctccatgaagcgcttccgcaaggaggaggagtccgagggcgccatctggtga

SEQ ID NO: 13010 - RNA, 9873 nt, synthetic construct
  misc_feature 1..9873: note = derived and/or modified CDS sequence (opt2) from DENV-3__JQ920489__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccttccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagtccatcgagggcaaggccgtccagcacgagaacctcaagtacaccgtcatcatcaccgtccacaccggcgaccagcaccaggtcggcaacgagacccagggcgtcaccgccgagatcaccccccaggcctccaccgtcgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaacaagaaggagctcctcgtcaccttcaagaacgcccacgccaagaagcaggaggtcgtcgtcctcggctcccaggagggcgccatgcacaccgccctcaccggcgccaccgagatccagacctccggcggcacctccatcttcgccggccacctcaagtgccgcctcaagatggacaagctcgagctcaagggcatgtcctacgccatgtgcctcaacgccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccatcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccatcgtcgtcggcgacgtcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgagaagtacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcatccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaagaccgacaacttcaccatgggcgtcctctgcctcgccatcctcttcgaggaggtcatgcgcggcaagttcggcaagaagcacatgatcgccggcgccctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcatgtgctccaacaccatcttcaccctcaccgtcgcctggcgcaccgccaccctcatcctcgccgtcatctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccttcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggccaacgtcaagaaggacctcatctcctacggcggcggctggaagctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcgtcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgtcgcctccgccgcccagcgccgcggccgcgtcggccgcaactcccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggacccgcgagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcgtcgcctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccttctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcatcgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatgaacgtcatcggcgagcgcatccgccgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagcgcccccgcctctgcacccgcgaggagttcatcaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcccactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctcctcgagaagaaggtcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtgggccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcaacgaggagttcctcgactacatgccctccatgaagcgcttccgcaaggaggaggagtccgagggcgccatctggtga

SEQ ID NO: 13011 - RNA, 9873 nt, synthetic construct
  misc_feature 1..9873: note = derived and/or modified CDS sequence (opt2) from DENV-3__KF824902__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatggccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagtccatcgagggcaaggtcgtccagcacgagaacctcaagtacaccgtcaccatcaccgtccacaccggcgaccagcaccaggtcggcaacgacacccagggcgtcaccgccgagatcaccccccaggcctccaccgtcgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttcggcggcgtctcctggatcatgaagatcggcatcggcgtcctcctcacctggatcggcctcaactccaagaacacctccatgtccttctcctgcatcgtcatcggcatcatcaccctctacctcggcaccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcgccctcaccccccagcccatggagctcaagtactcctggaagacctggggcaaggccaagatcgtcaccgccgagatccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagacctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagacccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcatgctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccgtctgccagtcctcctccatgcgcaagaccgactggctccccgtcgccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggccgcaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccaggccaacgccgagcccgagggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgtcctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgccgcgagttcgagctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacaccgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagcgcccccgcctctgcacccgcgaggagttcaccaagaaggtccgcaccaacgccgccatgggcgccgtcttcaccgaggagaaccagtgggagtccgcccgcgccgccgtcgaggacgaggagttctggaagctcgtcggccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 13012 - RNA, 9873 nt, synthetic construct
  misc_feature 1..9873: note = derived and/or modified CDS sequence (opt2) from DENV-3__KF824903__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatggccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagtccatcgagggcaaggtcgtccagcacgagaacctcaagtacaccgtcaccatcaccgtccacaccggcgaccagcaccaggtcggcaacgacacccagggcgtcaccgccgagatcaccccccaggcctccaccgtcgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttcggcggcgtctcctggatcatgaagatcggcatcggcgtcctcctcacctggatcggcctcaactccaagaacacctccatgtccttctcctgcatcgtcatcggcatcatcaccctctacctcggcaccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcgccctcaccccccagcccatggagctcaagtactcctggaagacctggggcaaggccaagatcgtcaccgccgagatccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagacctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcatgctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccgtctgccagtcctcctccatgcgcaagaccgactggctccccgtcgccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggccgcaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccaggccaacgccgagcccgagggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgagtgcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgccgcgagttcgagctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacaccgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagcgcccccgcctctgcacccgcgaggagttcaccaagaaggtccgcaccaacgccgccatgggcgccgtcttcaccgaggagaaccagtgggagtccgcccgcgccgccgtcgaggacgaggagttctggaagctcgtcggccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 13013 - RNA, 9873 nt, synthetic construct
  misc_feature 1..9873: note = derived and/or modified CDS sequence (opt2) from DENV-3__JF504679__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgtcatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacaccatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagatgtgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccgtctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagcgcgaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcatgctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccatccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcctcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgtcgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatcaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccgccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatccgccgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagcgcccccgcctctgcacccgcgaggagttcaccaagaaggtccgcaccaacgccgccatgggcgccgtcttcaccgaggagaaccagtgggactccgccaaggccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatgaaccccgagcaccgcctcctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 13014 - RNA, 9873 nt, synthetic construct
  misc_feature 1..9873: note = derived and/or modified CDS sequence (opt2) from DENV-3__KC425219__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcgccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtaccgcggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaaccccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatgttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcgtcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 13015 - RNA, 9873 nt, synthetic construct
  misc_feature 1..9873: note = derived and/or modified CDS sequence (opt2) from DENV-3__AY858037__SS-prME
  source 1..9873: mol_type = other RNA
acctccctctgcctcatgatgatgctccccgtcaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcgcccagacctggatgtccgccgagggcgcctggcgccaggtcgagaaggtcgagacctgggccttccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacgtcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagtccatcgagggcaaggtcgtccagcacgagaacctcaagtacaccgtcatcatcaccgtccacaccggcgaccagcaccaggtcggcaacgagacccagggcgtcaccgccgagatcaccccccaggcctccaccgtcgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaacaagaaggagctcctcgtcaccttcaagaacgcccacgccaagaagcaggaggtcgtcgtcctcggctcccaggagggcgccatgcacaccgccctcaccggcgccaccgagatccagacctccggcggcacctccatcttcgccggccacctcaagtgccgcctcaagatggacaagctcgagctcaagggcatgtcctacgccatgtgctccaacgccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcatcatcggcatcggcgaccgcgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgccccaacgcctcccgcgcctggaacgtctgggaggtcgaggactacggcttcggcgtcttcaccaccaacatctggctcaagctccgcgagatgtacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccgcaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcgtctccctcatgtgctccaacaccatcttcaccctcaccgtcgcctggcgcaccgccaccctcatcctcgccggcatctccctcttccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggcaaggagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgactggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgtcgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcgtcggcaagacctccatcggcctcatctgcgtcgtcgcctcctccggcatgctctggatggccgacatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccttctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacctaccgccgccccaccatcgagaaggacgtcgacctcggcgccggcacccgccacgtcaacgccgagcccgagacccccaacatggacgtcatcggcgagcgcatccgccgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccaccgtcacccagatggccatgaccgacaccacccccttcggccagcagcgcgtcttcaaggagaaggtcgacacccgcacccccaagcccatgcccggcacccgcaaggtcatggagatcaccgccgagtggctctggcgcaccctcggccgcaacaagcgcccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcatccgccagatggagggcgagggcgtcctctccaagaccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtgggccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcaacgaggagttcctcgactacatgccctccatgaagcgcttccgcaaggaggaggagtccgagggcgccatctggtga

SEQ ID NO: 13016 - RNA, 9873 nt, synthetic construct
  misc_feature 1..9873: note = derived and/or modified CDS sequence (opt2) from DENV-3__KJ737429__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 13017 - RNA, 9873 nt, synthetic construct
  misc_feature 1..9873: note = derived and/or modified CDS sequence (opt2) from DENV-3__DQ863638__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatcctcgtcaccccctccatggccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagtccatcgagggcaaggtcgtccagcacgagaacctcaagtacaccgtcatcatcaccgtccacaccggcgaccagcaccaggtcggcaacgagacccagggcgtcaccgccgagatcaccccccaggcctccaccgtcgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggcccccacacccccgagtgcccccgcgcctcccgcgcctggaacgtctgggaggtcgaggactacggcttcggcgtcttcaccaccaacatctggctcaagctccgcgaggagtacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgcctccgccggctccggcaaggtcgacaacttcaccatgggcttcctctgcctcgccatcctcttcgaggaggtcatgcgcggcaagttcggcaagaagcacatgatcgccggcgtcttcctcaccttcctcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacttcctcctcggcgtcggcctcgccatggccaccaccctccagctccccgaggacatcgagcagatggccaacggcatcgccctcggcctcatggccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttccgcggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgccacccactacgccatcatcggccccggcctccaggccaaggccacccgcgaggcccagaagcgcaccgccgccggcatcaccaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccgccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcatccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagcgcccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcttcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccgcggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcaacgaggagttcctcgactacatgccctccatgaagcgcttcaagaaggaggaggagtccgagggcgccatctggtga

SEQ ID NO: 13018 - RNA, 9873 nt, synthetic construct
  misc_feature 1..9873: note = derived and/or modified CDS sequence (opt2) from DENV-3__KJ737430__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatggccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagtccatcgagggcaaggtcgtccagcacgagaacctcaagtacaccgtcatcatcaccgtccacaccggcgaccagcaccaggtcggcaacgacacccagggcgtcaccgtcgagatcaccccccaggcctccaccgtcgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcatccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagcgcccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 13019 - RNA, 9873 nt, synthetic construct
  misc_feature 1..9873: note = derived and/or modified CDS sequence (opt2) from DENV-3__AY858040__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcgcccagacctggatgtccgccgagggcgcctggcgccaggtcgagaaggtcgagacctgggccttccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacgtcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagctcatcgagggcaaggtcgtccagcacgagaacctcaagtacaccgtcatcatcaccgtccacaccggcgaccagcaccaggtcggcaacgagacccagggcgtcaccgccgagatcaccccccaggcctccaccgtcgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaacaagaaggagctcctcgtcaccttcaagaacgcccacgccaagaagcaggaggtcgtcgtcctcggctcccaggagggcgccatgcacaccgccctcaccggcgccaccgagatccagacctccggcggcacctccatcttcgccggccacctcaagtgccgcctcaagatggacaagctcgagctcaagggcatgtcctacgccatgtgctccaacgccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcatcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagaagcagaactcctccttcatcatcgacggccccaacacccccgagtgccccaacgcctcccgcgcctggaacgtctgggaggtcgaggactacggcttcggcgtcttcaccaccaacatctggctcaagctccgcgagatgtacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccgcaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcgtctccctcatgtgctccaacaccatcttcaccctcaccgtcgcctggcgcaccgccaccctcatcctcgccggcatctccctcatgcccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcctactggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccgtccgctaccagaccaccgccaccaagtccgagcacaccggcaaggagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgactggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgtcgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgccccaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcgtcggcaagacctccatcggcctcatctgcgtcgtcgcctcctccggcatgctctggatggccgacatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccttctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacctaccgccgccccaccatcgagaaggacgtcgacctcggcgccggcacccgccacgtcaacgccgagcccgagacccccaacatggacgtcatcggcgagcgcatccgccgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccaccgtcacccagatggccatgaccgacaccacccccttcggccagcagcgcgtcttcaaggagaaggtcgacacccgcacccccaagcccatgcccggcacccgcaaggtcatggagatcaccgccgagtggctctggcgcaccctcggccgcaacaagcgcccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggagcccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcatccgccagatggagggcgaggacgtcctctccaagaccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtgggccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcaacgaggagttcctcgactacatgccctccatgaagcgcttccgcaaggaggaggagtccgagggcgccatctggtga

SEQ ID NO: 13020 - RNA, 9873 nt, synthetic construct
  misc_feature 1..9873: note = derived and/or modified CDS sequence (opt2) from DENV-3__AY858041__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcgcccagacctggatgtccgccgagggcgcctggcgccaggtcgagaaggtcgagacctgggccttccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacgtcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagctcatcgagggcaaggtcgtccagcacgagaacctcaagtacaccgtcatcatcaccgtccacaccggcgaccagcaccaggtcggcaacgagacccagggcgtcaccgccgagatcaccccccaggcctccaccgtcgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaacaagaaggagctcctcgtcaccttcaagaacgcccacgccaagaagcaggaggtcgtcgtcctcggctcccaggagggcgccatgcacaccgccctcaccggcgccaccgagatccagacctccggcggcacctccatcttcgccggccacctcaagtgccgcctcaagatggacaagctcgagctcaagggcatgtcctacgccatgtgctccaacgccttcgtcctcaagaaggaggtctccgagacccagcacggcaccatcctcatcaaggtcgagtacaagggcgaggacgccccctgcaagatccccttctccaccgaggacggccagggccaggcccacaacggccgcctcatcaccgccaaccccgtcgtcaccaagaaggaggagcccgtcaacatcgaggccgagtcccccttcggcgagtccaacatcatcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagatccagaactcctccttcatcatcgacggccccaacacccccgagtgccccaacgcctcccgcgcctggaacgtctgggaggtcgaggactacggcttcggcgtcttcaccaccaacatctggctcaagctccgcgagatgtacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgacgacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcatgttcgtcctcctcctctccggccagatcacctggcgcgacatggcccgcaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcgtctccctcacctgctccaacaccatcttcaccctcaccgtcgcctggcgcaccgccaccctcatcctcgccggcatctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggaagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggcaaggagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgactggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgtcgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcgtcggcaagacctccatcggcctcatctgcgtcgtcgcctcctccggcatgctctggatggccgacatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcctccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccttctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacctaccgccgccccaccatcgagaaggacgtcgacctcggcgccggcacccgccacgtcaacgccgagcccgagacccccaacatggacgtcatcggcgagcgcatccgccgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccaccgtcacccagatggccatgaccgacaccacccccttcggccagcagcgcgtcttcaaggagaaggtcgacacccgcacccccaagcccatgcccggcacccgcaaggtcatggagatcaccgccgagtggctctggcgcaccctcggccgcaacaagcgcccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagcagggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcatccgccagatggagggcgagggcgtcctctccaagaccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtgggccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcaacgaggagttcctcgactacatgccctccatgaagcgcttccgcaaggaggaggagtccgagggcgccatctggtga

SEQ ID NO: 13021 - RNA, 9873 nt, synthetic construct
  misc_feature 1..9873: note = derived and/or modified CDS sequence (opt2) from DENV-3__KC261634__SS-prME
  source 1..9873: mol_type = other RNA
acctccatctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaaccgccccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatccgcgtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcaccggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggcccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagatccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgtcggcgtcctcttcaccttcgtcctcctcctctccggccagatcacctggcgcgacatgacccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacgcccccaagaagcgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgccgtctcctccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagcgcctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatggagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccaccgcctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccgcctcgcctccgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgaggacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 13022 - RNA, 9873 nt, synthetic construct
  misc_feature 1..9873: note = derived and/or modified CDS sequence (opt2) from DENV-3__JN662391__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacgagcagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacaccatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagatgtgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcctcaccttcatgctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccatccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcctcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgtcgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatcaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacccacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccgccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatccgccgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagcgcccccgcctctgcacccgcgaggagttcaccaagaaggtccgcaccaacgccgccatgggcgccgtcttcaccgaggagaaccagtgggactccgccaaggccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatgaaccccgagcaccgcctcctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatctccaccgccatccagcaggtccgctccctcatcggcaacgaggagttcctcgactacatgccctccatgaagcgcttccgcaaggaggaggagtccgagggcgccatctggtga

SEQ ID NO: 13023 - RNA, 9873 nt, synthetic construct
  misc_feature 1..9873: note = derived and/or modified CDS sequence (opt2) from DENV-3__AY858043__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcgcccagacctggatgtccgccgagggcgcctggcgccaggccgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacgtcaccaccgactcccgctgccccacccagggcgaggccatcctccccgaggagcaggaccagaactacgtctgccgccacacctacgtcgaccgcggctggggcaacggctgcggcctcttcggcaagggctccctcgtcacctgcgccaagttccagtgcctcgagctcatcgagggcaaggtcgtccagcacgagaacctcaagtacaccgtcatcatcaccgtccacaccggcgaccagcaccaggtcggcaacgagacccagggcgtcaccgccgagatcaccccccaggcctccaccgtcgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaacaagaaggagctcctcgtcaccttcaagaacgcccacgccaagaagcaggaggtcgtcgtcctcggctcccaggagggcgccatgcacaccgccctcaccggcgccaccgagatccagacctccggcggcacctccatcttcgccggccacctcaagtgccgcctcaagatggacaagctcgagctcaagggcatgtcctacgccatgtgctccaacgccttcgtcctcaagaaggaggtctccgagacccagcacggcaccatcctcatcaaggtcgagtacaagggcgaggacgccccctgcaagatccccttctccaccgaggacggccagggcaaggtccacaacggccgcctcatcaccgccaaccccgtcgtcaccaagaaggaggagcccgtcaacatcgaggccgagccccccttcggcgagtccaacatcatcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaaggtcgtcaccgccgagatccagaactcctccttcatcatcgacggccccaacacccccgagtgccccaacgcctcccgcgcctggaacgtctgggaggtcgaggactacggcttcggcgtcttcaccaccaacatctggctcaagctccgcgagatgtacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcatgttcgtcctcctcctctccggccagatcacctggcgcgacatggcccgcaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcgtctccctcacctgctccaacaccatcttcaccctcaccgtcgcctggcgcaccgccaccctcatcctcgccggcatctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcgcaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggcaaggagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgactggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgtcgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccttcctcctcctcggcctcatgatcctcctcaccggcggcgccatgctcttcctcatctccggcaagggcgtcggcaagacctccatcggcctcatctgcgtcgtcgcctcctccggcatgctctggatggccgacatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccttctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacctaccgccgccccaccatcgagaaggacgtcgacctcggcgccggcacccgccacgtcaacgccgagcccgagacccccaacatggacgtcatcggcgagcgcatccgccgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccaccgtcacccagatggccatgaccgacaccacccccttcggccagcagcgcgtcttcaaggagaaggtcgacacccgcacccccaagcccatgcccggcacccgcaaggtcatggagatcaccgccgagtggctctggcgcaccctcggccgcaacaagcgcccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagcagggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcatccgccagatggagggcgagggcgtcctctccaagaccgacctcgagaacccccacctcctcgagaagaagatcatccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctcccgcggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtgggccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcaacgaggagttcctcgactacatgccctccatgaagcgcttccgcaaggaggaggagtccgagggcgccatctggtga

SEQ ID NO: 13024 - RNA, 9873 nt, synthetic construct
  misc_feature 1..9873: note = derived and/or modified CDS sequence (opt2) from DENV-3__AY858044__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccatcacctacaagtgccccctcatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcgcccagacctggatgtccgccgagggcgcctggcgccaggtcgagaaggtcgagacctgggccttccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacgtcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagctcatcgagggcaaggtcgtccagcacgagaacctcaagtacaccgtcatcatcaccgtccacaccggcgaccagcaccaggtcggcaacgagacccagggcgtcaccgccgagatcaccccccaggcctccaccgtcgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaacaagaaggagctcctcgtcaccttcaagaacgcccacgccaagaagcaggaggtcgtcgtcctcggctcccaggagggcgccatgcacaccgccctcaccggcgccaccgagatccagacctccggcggcacctccatcttcgccggccacctcaagtgccgcctcaagatggacaagctcgagctcaagggcatgtcctacgccatgtgctccaacgccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcatcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagatccagaactcctccttcatcatcgacggccccaacacccccgagtgccccaacgcctcccgcgcctggaacgtctgggaggtcgaggactacggcttcggcgtcttcaccaccaacatctggctcaagctccgcgagatgtacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcatgttcgtcctcctcctctccggccagatcacctggcgcgacatggcccgcaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcgtctccctcacctgctccaacaccatcttcaccctcaccgtcgcctggcgcaccgccaccctcatcctcgccggcatctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggcaaggagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgactggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgtcgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcgtcggcaagacctccatcggcctcatctgcgtcgtcgcctcctccggcatgctctggatggccgacatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccttctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacctaccgccgccccaccatcgagaaggacgtcgacctcggcgccggcacccgccacgtcaacgccgagcccgagacccccaacatggacgtcatcggcgagcgcatccgccgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccaccgtcacccagatggccatgaccgacaccacccccttcggccagcagcgcgtcttcaaggagaaggtcgacacccgcacccccaagcccatgcccggcacccgcaaggtcatggagatcaccgccggctggctctggcgcaccctcggccgcaacaagcgcccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagcagggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcatccgccagatggagggcgagggcgtcctctccaagaccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtgggccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcaacgaggagttcctcgactacatgccctccatgaagcgcttccgcaaggaggaggagtccgagggcgccatctggtga

SEQ ID NO: 13025 - RNA, 9873 nt, synthetic construct
  misc_feature 1..9873: note = derived and/or modified CDS sequence (opt2) from DENV-3__AY858045__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccatcacctacaagtgccccctcatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcgcccagacctggatgtccgccgagggcgcctggcgccaggtcgagaaggtcgagacctgggccttccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacgtcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagctcatcgagggcaaggtcgtccagcacgagaacctcaagtacaccgtcatcatcaccgtccacaccggcgaccagcaccaggtcggcaacgagacccagggcgtcaccgccgagatcaccccccaggcctccaccgtcgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaacaagaaggagctcctcgtcaccttcaagaacgcccacgccaagaagcaggaggtcgtcgtcctcggctcccaggagggcgccatgcacaccgccctcaccggcgccaccgagatccagacctccggcggcacctccatcttcgccggccacctcaagtgccgcctcaagatggacaagctcgagctcaagggcatgtcctacgccatgtgctccaacgccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcatcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccatcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagatccagaactcctccttcatcatcgacggccccaacacccccgagtgccccaacgcctcccgcgcctggaacgtctgggaggtcgaggactacggcttcggcgtcttcaccaccaacatctggctcaagctccgcgagatgtacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcatgttcgtcctcctcctctccggccagatcacctggcgcgacatggcccgcaccctcatcatgatcggctccaacgcctccgaccgcatgggcatgggcgtcacctacctcgccctcatcgccaccttcgagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcgtctccctcacctgctccaacaccatcttcaccctcaccgtcgcctggcgcaccgccaccctcatcctcgccggcatctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggcaaggagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgactggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgtcgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcgtcggcaagacctccatcggcctcatctgcgtcgtcgcctcctccggcatgctctggatggccgacatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccttctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagcgcctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacctaccgccgccccaccatcgagaaggacgtcgacctcggcgccggcacccgccacgtcaacgccgagcccgagacccccaacatggacgtcatcggcgagcgcatccgccgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccaccgtcacccagatggccatgaccgacaccacccccttcggccagcagcgcgtcttcaaggagaaggtcgacacccgcacccccaagcccatgcccggcacccgcaaggtcatggagatcaccgccggctggctctggcgcaccctcggccgcaacaagcgcccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagcagggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcatccgccagatggagggcgagggcgtcctctccaagaccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtgggccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcaacgaggagttcctcgactacatgccctccatgaagcgcttccgcaaggaggaggagtccgagggcgccatctggtga

SEQ ID NO: 13026 - RNA, 9873 nt, synthetic construct
  misc_feature 1..9873: note = derived and/or modified CDS sequence (opt2) from DENV-3__AY858046__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccatcacctacaagtgccccctcatcaccgaggtcgagcccgaggacatcgactgctggtgcaacctcacctccacctgggtcacctacggcacctgcaaccaggtcggcgagcaccgccgcgacaagcgctccgtcgccctcgccccccacgtcggcatgggcctcgacacccgcgcccagacctggatgtccgccgagggcgcctggcgccaggtcgagaaggtcgagacctgggccttccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacgtcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagctcatcgagggcaaggtcgtccagcacgagaacctcaagtacaccgtcatcatcaccgtccacaccggcgaccagcaccaggtcggcaacgagacccagggcgtcaccgccgagatcaccccccaggcctccaccgtcgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaacaagaaggagctcctcgtcaccttcaagaacgcccacgccaagaagcaggaggtcgtcgtcctcggctcccaggagggcgccatgcacaccgccctcaccggcgccaccgagatccagacctccggcggcacctccatcttcgccggccacctcaagtgccgcctcaagatggacaagctcgagctcaagggcatgtcctacgccatgtgctccaacgccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcatcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagatccagaactcctccttcatcatcgacggccccaacacccccgagtgccccaacgcctcccgcgcctggaacgtctgggaggtcgaggactacggcttcggcgtcttcaccaccaacatctggctcaagctccgcgagatgtacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcatgttcgtcctcctcctctccggccagatcacctggcgcgacatggcccgcaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcgtctccctcacctgctccaacaccatcttcaccctcaccgtcgcctggcgcaccgccaccctcatcctcgccggcatctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggcaaggagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgactggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgtcgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcgtcggcaagacctccatcggcctcatctgcgtcgtcgcctcctccggcatgctctggatggccgacatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcatgctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccttctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctccgccgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacctaccgccgccccaccatcgagaaggacgtcgacctcggcgccggcacccgccacgtcaacgccgagcccgagacccccaacatggacgtcatcggcgagcgcatccgccgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccaccgtcacccagatggccatgaccgacaccacccccttcggccagcagcgcgtcttcaaggagaaggtcgacacccgcacccccaagcccatgcccggcacccgcaaggccatggagatcaccgccggctggctctggcgcaccctcggccgcaacaagcgcccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagcagggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggtccagctcatccgccagatggagggcgagggcgtcctctccaagaccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtgggccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcaacgaggagttcctcgactacatgccctccatgaagcgcttccgcaaggaggaggagtccgagggcgccatctggtga

SEQ ID NO: 13027 - RNA, 9873 nt, synthetic construct
  misc_feature 1..9873: note = derived and/or modified CDS sequence (opt2) from DENV-3__AY858047__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcgcccagacctggatgtccgccgagggcgcctggcgccaggtcgagaaggtcgagacctgggccttccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacgtcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagctcatcgagggcaaggtcgtccagcacgagaacctcaagtacaccgtcatcatcaccgtccacaccggcgaccagcaccaggtcggcaacgagacccagggcgtcaccgccgagatcaccccccaggcctccaccgtcgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaacaagaaggagctcctcgtcaccttcaagaacgcccacgccaagaagcaggaggtcgtcgtcctcggctcccaggagggcgccatgcacaccgccctcaccggcgccaccgagatccagacctccggcggcacctccatcttcgccggccacctcaagtgccgcctcaagatggacaagctcgagctcaagggcatgtcctacgccatgtgctccaacgccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcatcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcatcctcgagcagggcaagcgcaccctcaccccccagcccatggagctcaagtactcctggaagacctggggcaaggccaagatcgtcaccgccgagatccagaactcctccttcatcatcgacggccccaacacccccgagtgccccaacgcctcccgcgcctggaacgtctgggaggtcgaggactacggcttcggcgtcttcaccaccaacatctggctcaagctccgcgagatgtactcccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccgcaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcgtctccctcatgtgctccaacaccatcttcaccctcaccgtcgcctggcgcaccgccaccctcatcctcgccggcatctccctcctccccctctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcgcacccagcgctccggcgtcctctgggacgtcccctccccccccgagacccagaaggccgagctcgaggagggcgtctaccgcatcaagcagcagggcatcctcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggcaaggagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgactggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgtcgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgtcatgctcttcctcatctccggcaagggcgtcggcaagacctccatcggcctcatctgcgtcgtcgcctcctccggcatgctctggatggccgacatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgcctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccttctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccgccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacctaccgccgccccaccatcgagaaggacgtcgacctcggcgccggcacccgccacgtcaacgccgagcccgagacccccaacatggacgtcatcggcgagcgcatccgccgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccaccgtcacccagatggccatgaccgacaccacccccttcggccagcagcgcgtcttcaaggagaaggtcgacacccgcacccccaagcccatgcccggcacccgcaaggtcatggagatcaccgccgagtggctctggcgcaccctcggccgcaacaagcgcccccgcctctgcacccgcgaggagttcaccaagaaggtccgcaccaacgccgccatgggcgccgtcttcaccgaggagaaccagtgggactccgccaaggccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcatccgccagatggagggcgagggcgtcctctccaagaccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtgggccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcatcgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcaacgaggagttcctcgactacatgccctccatgaagcgcttccgcaaggaggaggagtccgagggcgccatctggtga

SEQ ID NO: 13028 - RNA, 9873 nt, synthetic construct
  misc_feature 1..9873: note = derived and/or modified CDS sequence (opt2) from DENV-3__HQ332170__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgactacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacaccggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagcagtgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgctccatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcacaagcagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 13029 - RNA, 9873 nt, synthetic construct
  misc_feature 1..9873: note = derived and/or modified CDS sequence (opt2) from DENV-3__AY858038__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccttccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacgtcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagtccatcgagggcaaggtcgtccagcacgagaacctcaagtacaccgtcatcatcaccgtccacaccggcgaccagcaccaggtcggcaacgagacccagggcgtcaccgccgagatcaccccccaggcctccaccgtcgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaacaagaaggagctcctcgtcaccttcaagaacgcccacgccaagaagcaggaggtcgtcgtcctcggctcccaggagggcgccatgcacaccgccctcaccggcgccaccgagatccagacctccggcggcacctccatcttcgccggccacctcaagtgccgcctcaagatggacaagctcgagctcaagggcatgtcctacgccatgtgcctcaacgccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatccgcctcaccgtcgtcgtcggcgacaccatcggcgtcctccagcagggcaagcgcaccctccccccccagcccatggagctcaagtactcctggaagacctggggcaaggccaagatcgtcaccgccaagacccagaactcctccttcatcatcgacggccccaacacccccgagtggccctccgcctcccgcgcctggaacgtctgggaggtcgaggactacggcttcggcgtcttcaccaccaacatctggctcaagctccgcgagatgtacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccgcaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcgtcacccagttcgagacctaccagctctggaccgccctcgtctccctcatgtgctccaacaccatcttcaccctcaccgtcgcctggcgcaccgccaccctcatcctcgccggcatctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcatctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcatccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggcaaggagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgactggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagcgcaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgtcgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcgtcgcctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccttctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatccgccgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccaccgtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagcgcccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtgggccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcaacgaggagttcctcgactacatgccctccatgaagcgcttccgcaaggaggaggagtccgagggcgccatctggtga

SEQ ID NO: 13030 - RNA, 9873 nt, synthetic construct
  misc_feature 1..9873: note = derived and/or modified CDS sequence (opt2) from DENV-3__AY858039__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcgcccagacctggatgtccgccgagggcgcctggcgccaggtcgagaaggtcgagacctgggccttccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacgtcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagctcatcgagggcaaggtcgtccagcacgagaacctcaagtacaccgtcatcatcaccgtccacaccggcgaccagcaccaggtcggcaacgagacccagggcgtcaccgccgagatcaccccccaggcctccaccgtcgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaacaagaaggagctcctcgtcaccttcaagaacgcccacgccaagaagcaggaggtcgtcgtcctcggctcccaggagggcgccatgcacaccgccctcaccggcgccaccgagatccagacctccggcggcacctccatcttcgccggccacctcaagtgccgcctcaagatggacaagctcgagctcaagggcatgtcctacgccatgtgctccaacgccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcatcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagatccagaactcctccttcatcatcgacggccccaacacccccgagtgccccaacgcctcccgcgcctggaacgtctgggaggtcgaggactacggcttcggcgtcttcaccaccaacatctggctcaagctccgcgagatgtacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcatcttcgtcctcctcctctccggccagatcacctggcgcgacatggcccgcaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcgtctccctcacctgctccaacaccatcttcaccctcaccgtcgcctggcgcaccgccaccctcatcctcgccggcatctccctcctccccgtctgccagtcctcctccatgcgcaagaccgactggctccccatgaccgtcgccgccatgggcgtccccccctcccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcgcggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggcaaggagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgactggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgtcgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcgtcggcaagacctccatcggcctcatctgcgtcgtcgcctcctccggcatgctctggatggccgacatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccttctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacctaccgccgccccaccatcgagaaggacgtcgacctcggcgccggcacccgccacgtcaacgccgagcccgagacccccaacatggacgtcatcggcgagcgcatccgccgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccaccgtcacccagatggccatgaccgacaccacccccttcggccagcagcgcgtcttcaaggagaaggtcgacacccgcacccccaagcccatgcccggcacccgcaaggtcatggagatcaccgccgagtggctctggcgcaccctcggccgcaacaagcgcccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcatccgccagatggagggcgagggcgtcctctccaagaccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtgggccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcaacgaggagttcctcgactacatgccctccatgaagcgcttccgcaaggaggaggagtccgagggcgccatctggtga

SEQ ID NO: 13031 - RNA, 9873 nt, synthetic construct
  misc_feature 1..9873: note = derived and/or modified CDS sequence (opt2) from DENV-3__JN368477__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagtccaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggcaacggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcgccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacccacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcgtcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctccgcaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgacaaggagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccggccaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactggatccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagaccgagggcgccatctggtga

SEQ ID NO: 13032 - RNA, 9873 nt, synthetic construct
  misc_feature 1..9873: note = derived and/or modified CDS sequence (opt2) from DENV-3__EF643017__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcgccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttctccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtaccgcggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcacccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatgacccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatgttcaccctcaccgtcgcctggcgcaccgccaccctcatcctcgccggcgtctccctcctccccgtctgccagtcctcctccatgcgcaagaccgactggctccccatggccgtcgccgccatgggcgtctcccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacccgcgaggaggaggccgagcagaccggcgtctcccacaacctcatgaccaccgtcgacgacgacggcaccatgcgcatcaaggacgacgagaccgagaacatcctcaccgtcctcctcaagaccgccctcctcatcgtctccggcgtcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgtcctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgtcggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacaccggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 13033 - RNA, 9873 nt, synthetic construct
  misc_feature 1..9873: note = derived and/or modified CDS sequence (opt2) from DENV-3__DQ675519__SS-prME
  source 1..9873: mol_type = other RNA
acctccatctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccttccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacgtcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagtccatcgagggcaaggtcgtccagcacgagaacctcaagtacaccgtcatcatcaccgtccacaccggcgaccagcaccaggtcggcaacgagacccagggcgtcaccgccgagatcaccccccaggcctccaccgtcgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaacaagaaggagctcctcgtcaccttcaagaacgcccacgccaagaagcaggaggtcgtcgtcctcggctcccaggagggcgccatgcacaccgccctcaccggcgccaccgagatccagacctccggcggcacctccatcttcgccggccacctcaagtgccgcctcaagatggacaagctcgagctcaagggcatgtcctacgccatgtgcctcaacgccttcgtcctcaagaaggaggtctccgagacccagcacggcaccatcctcatcaaggtcgagtacaagggcgaggacgccccctgccgcatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggcaacggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcgtcgccctcggcctcatggccctcaagctcatcacccagttcgagacctaccagctctggaccgccctcgtctccctcatgtgctccaacaccatcttcaccctcaccgtcgcctggcgcaccgccaccctcatcctcgccggcatctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccatcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcatccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccaccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggcaaggagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgtcgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcctaccgcacccgctccgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcgtcgcctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccttctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccaaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatccgccgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccaccgtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagcgcccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagacccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcaacgaggagttcctcgactacatgccctccatgaagcgcttccgcaaggaggaggagtccgagggcgccatctggtga

SEQ ID NO: 13034 - RNA, 9873 nt, synthetic construct
  misc_feature 1..9873: note = derived and/or modified CDS sequence (opt2) from DENV-3__DQ675521__SS-prME
  source 1..9873: mol_type = other RNA
acctccttctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagatccagaactcctccttcatcatcgacggccccaacacccccgagtgcccctccgcctcccgcgcctggaacgtctgggaggtcgaggactacggcttcggcgtcttcaccaccaacatctggctcaagctccgcgagatgtacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgtcggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttccgcgccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgcctccgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 13035 - RNA, 9873 nt, synthetic construct
  misc_feature 1..9873: note = derived and/or modified CDS sequence (opt2) from DENV-3__DQ675522__SS-prME
  source 1..9873: mol_type = other RNA
acctccttctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagatccagaactcctccttcatcatcgacggccccaacacccccgagtgcccctccgcctcccgcgcctggaacgtctgggaggtcgaggactacggcttcggcgtcttcaccaccaacatctggctcaagctccgcgagatgtacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgtcggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgcctccgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 13036 - RNA, 9873 nt, synthetic construct
  misc_feature 1..9873: note = derived and/or modified CDS sequence (opt2) from DENV-3__DQ675527__SS-prME
  source 1..9873: mol_type = other RNA
acctccttctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagatccagaactcctccttcatcatcgacggccccaacacccccgagtgcccctccgcctcccgcgcctggaacgtctgggaggtcgaggactacggcttcggcgtcttcaccaccaacatctggctcaagctccgcgagatgtacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgtcggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcatcaaccagatcctcgaggagaacatggacgtcgagatctggaccaaggagggcgagcgcaagaacctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgcctccgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 13037 - RNA, 9873 nt, synthetic construct
  misc_feature 1..9873: note = derived and/or modified CDS sequence (opt2) from DENV-3__DQ675528__SS-prME
  source 1..9873: mol_type = other RNA
acctccttctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgtcctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagatccagaactcctccttcatcatcgacggccccaacacccccgagtgcccctccgcctcccgcgcctggaacgtctgggaggtcgaggactacggcttcggcgtcttcaccaccaacatctggctcaagctccgcgagatgtacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgtcggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgcctccgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 13038 - RNA, 9873 nt, synthetic construct
  misc_feature 1..9873: note = derived and/or modified CDS sequence (opt2) from DENV-3__DQ675530__SS-prME
  source 1..9873: mol_type = other RNA
acctccttctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctcccccacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagatccagaactcctccttcatcatcgacggccccaacacccccgagtgcccctccgcctcccgcgcctggaacgtctgggaggtcgaggactacggcttcggcgtcttcaccaccaacatctggctcaagctccgcgagatgtacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgtcggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgcctccgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 13039 - RNA, 9873 nt, synthetic construct
  misc_feature 1..9873: note = derived and/or modified CDS sequence (opt2) from DENV-3__DQ675533__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccacccacgaggccctcctccccgagtacggcaccctcggcctcgagtgctccccccgcaccggcctcgacttcaacgagatgatcctcctcaccatgaagaacaaggcctggatggtccaccgccagtggttcttcgacctccccctcccctgggcctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacaccctcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagtcctgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcctccgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcctcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgaggtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcgtccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagcgcccccgcctctgcacccgcgaggagttcaccaagaaggtccgcaccaacgccgccatgggcgccgtcttcaccgaggagaaccagtgggactccgccaaggccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcatccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcgtccgccagatggagggcgagggcgtcctcaccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggagaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 13040 - RNA, 9873 nt, synthetic construct
  misc_feature 1..9873: note = derived and/or modified CDS sequence (opt2) from DENV-3__AY744677__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccttccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacgtcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagtccatcgagggcaaggccgtccagcacgagaacctcaagtacaccgtcatcatcaccgtccacaccggcgaccagcaccaggtcggcaacgagacccagggcgtcaccgccgagatcaccccccaggcctccaccgtcgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaacaagaaggagctcctcgtcaccttcaagaacgcccacgccaagaagcaggaggtcgtcgtcctcggctcccaggagggcgccatgcacaccgccctcaccggcgccaccgagatccagacctccggcggcacctccatcttcgccggccacctcaagtgccgcctcaagatggacaagctcgagctcaagggcatgtcctacgccatgtgcctcaacgccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccatcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccatcgtcgtcggcgacgtcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgagatgtacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggccgacaacttcaccatgggcgtcctctgcctcgccatcctcttcgaggaggtcatgcgcggcaagttcggcaagaagcacatgatcgccggcgccctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcgtctccctcatgtgctccaacaccatcttcaccctcaccgtcgcctggcgcaccgccaccctcatcctcgccgtcatctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccttcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggccaacgtcaagaaggacctcatctcctacggcggcggctggaagctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcgtcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgtcgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcgtcgcctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccttctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagcgcctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatccgccgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagcgcccccgcctctgcacccgcgaggagttcatcaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctcctcgagaagaaggtcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtgggccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcaacgaggagttcctcgactacatgccctccatgaagcgcttccgcaaggaggaggagtccgagggcgccatctggtga

SEQ ID NO: 13041 - RNA, 9873 nt, synthetic construct
  misc_feature 1..9873: note = derived and/or modified CDS sequence (opt2) from DENV-3__AY744678__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccttccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacgtcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagtccatcgagggcaaggccgtccagcacgagaacctcaagtacaccgtcatcatcaccgtccacaccggcgaccagcaccaggtcggcaacgagacccagggcgtcaccgccgagatcaccccccaggcctccaccgtcgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaacaagaaggagctcctcgtcaccttcaagaacgcccacgccaagaagcaggaggtcgtcgtcctcggctcccaggagggcgccatgcacaccgccctcaccggcgccaccgagatccagacctccggcggcacctccatcttcgccggccacctcaagtgccgcctcaagatggacaagctcgagctcaagggcatgtcctacgccatgtgcctcaacgccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccatcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccatcgtcgtcggcgacgtcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgagatgtacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggccgacaacttcaccatgggcgtcctctgcctcgccatcctcttcgaggaggtcatgcgcggcaagttcggcaagaagcacatgatcgccggcgccctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcgtctccctcatgtgctccaacaccatcttcaccctcaccgtcgcctggcgcaccgccaccctcatcctcgccgtcatctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccttcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggccaacgtcaagaaggacctcatctcctacggcggcggctggaagctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcgtcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgtcgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcgtcgcctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccttctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatccgccgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagcgcccccgcctctgcacccgcgaggagttcatcaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctcctcgagaagaaggtcacccagtggctcgagaccaagggcgtcgagcgcctcaagcgcatggccatctccggcgacgactgcgtcgtcaagcccatcgacgaccgcttcgcctccgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtgggccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcaacgaggagttcctcgactacatgccctccatgaagcgcttccgcaaggaggaggagtccgagggcgccatctggtga

SEQ ID NO: 13042 - RNA, 9873 nt, synthetic construct
  misc_feature 1..9873: note = derived and/or modified CDS sequence (opt2) from DENV-3__AY744679__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccttccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacgtcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagtccatcgagggcaaggtcgtccagcacgagaacctcaagtacaccgtcatcatcaccgtccacaccggcgaccagcaccaggtcggcaacgagacccagggcgtcaccgccgagatcaccccccaggcctccaccgtcgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaacaagaaggagctcctcgtcaccttcaagaacgcccacgccaagaagcaggaggtcgtcgtcctcggctcccaggagggcgccatgcacaccgccctcaccggcgccaccgagatccagacctccggcggcacctccatcttcgccggccacctcaagtgccgcctcaagatggacaagctcgagctcaagggcatgtcctacgccatgtgcctcaacgccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccatcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggccaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacgtcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgagatgtacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggccgacaacttcaccatgggcgtcctctgcctcgccatcctcttcgaggaggtcatgcgcggcaagttcggcaagaagcacatgatcgccggcgccctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcgtctccctcatgtgctccaacaccatcttcaccctcaccgtcgcctggcgcaccgccaccctcatcctcgccgtcatctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccttcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggccaacgtcaagaaggacctcatctcctacggcggcggctggaagctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcgtcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgtcgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcgtcgcctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccttctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacatcatcggcgagcgcatccgccgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagcgcccccgcctctgcacccgcgaggagttcatgaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctcctcgagaagaaggtcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtgggccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtctccacctgggaggacgtcccctacctcggcaagcgcgaggaccagtggtgcggctccctcatcggcctcacctcccgcgccacctgggcccagaacatcctcaccgccatccagcaggtccgctccctcatcggcaacgaggagttcctcgactacatgccctccatgaagcgcttccgcaaggaggaggagtccgagggcgccatctggtga

SEQ ID NO: 13043 - RNA, 9873 nt, synthetic construct
  misc_feature 1..9873: note = derived and/or modified CDS sequence (opt2) from DENV-3__AY744680__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccttccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacgtcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagtccatcgagggcaaggccgtccagcacgagaacctcaagtacaccgtcatcatcaccgtccacaccggcgaccagcaccaggtcggcaacgagacccagggcgtcaccgccgagatcaccccccaggcctccaccgtcgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaacaagaaggagctcctcgtcaccttcaagaacgcccacgccaagaagcaggaggtcgtcgtcctcggctcccaggagggcgccatgcacaccgccctcaccggcgccaccgagatccagacctccggcggcacctccatcttcgccggccacctcaagtgccgcctcaagatggacaagctcgagctcaagggcatgtcctacgccatgtgcctcaacgccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccatcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccatcgtcgtcggcgacgtcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgagatgtacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggccgacaacttcaccatgggcgtcctctgcctcgccatcctcttcgaggaggtcatgcgcggcaagttcggcaagaagcacatgatcgccggcgccctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcgtctccctcatgtgctccaacaccatcttcaccctcaccgtcgcctggcgcaccgccaccctcatcctcgccgtcatctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccttcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggccaacgtcaagaaggacctcatctcctacggcggcggctggaagctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcgtcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgtcgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcgtcgcctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccttctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatccgccgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagcgcccccgcctctgcacccgcgaggagttcatcaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctcctcgagaagaaggtcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtgggccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcaacgaggagttcctcgactacatgccctccatgaagcgcttccgcaaggaggaggagtccgagggcgccatctggtga

SEQ ID NO: 13044 - RNA, 9873 nt, synthetic construct
  misc_feature 1..9873: note = derived and/or modified CDS sequence (opt2) from DENV-3__AY744681__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccttccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggccgcatcaccaacgtcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagtccatcgagggcaaggccgtccagcacgagaacctcaagtacaccgtcatcatcaccgtccacaccggcgaccagcaccaggtcggctccgagacccagggcgtcaccgccgagatcaccccccaggcctccaccgtcgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaacaagaaggagctcctcgtcaccttcaagaacgcccacgccaagaagcaggaggtcgtcgtcctcggctcccaggagggcgccatgcacaccgccctcaccggcgccaccgagatccagacctccggcggcacctccatcttcgccggccacctcaagtgccgcctcaagatggacaagctcgagctcaagggcatgtcctacgccatgtgcctcaacgccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccatcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccatcgtcgtcggcgacgtcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgagatgtacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggccgacaacttcaccatgggcgtcctctgcctcgccatcctcttcgaggaggtcatgcgcggcaagttcggcaagaagcacatgatcgccggcgccctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcgtctccctcatgtgctccaacaccatcttcaccctcaccgtcgcctggcgcaccgccaccctcatcctcgccgtcatctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccttcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggccaacgtcaagaaggacctcatctcctacggcggcggctggaagctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcgtcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgtcgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcgtcgcctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccttctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatccgccgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagcgcccccgcctctgcacccgcgaggagttcatcaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccgcctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctcctcgagaagaaggtcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtgggccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcaacgaggagttcctcgactacatgccctccatgaagcgcttccgcaaggaggaggagtccgagggcgccatctggtga

SEQ ID NO: 13045 - RNA, 9873 nt, synthetic construct
  misc_feature 1..9873: note = derived and/or modified CDS sequence (opt2) from DENV-3__AY744682__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccttccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacgtcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagtccatcgagggcaaggccgtccagcacgagaacctcaagtacaccgtcaccatcaccgtccacaccggcgaccagcaccaggtcggcaacgagacccagggcgtcaccgccgagatcaccccccaggcctccaccgtcgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaacaagaaggagctcctcgtcaccttcaagaacgcccacgccaagaagcaggaggtcgtcgtcctcggctcccaggagggcgccatgcacaccgccctcaccggcgccaccgagatccagacctccggcggcacctccatcttcgccggccacctcaagtgccgcctcaagatggacaagctcgagctcaagggcatgtcctacgccatgtgcctcaacgccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccatcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccatcgtcgtcggcgacgtcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggccgacaacttcaccatgggcgtcctctgcctcgccatcctcttcgaggaggtcatgcgcggcaagttcggcaagaagcacatgatctccggcgccctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcgtctccctcatgtgctccaacaccatcttcaccctcaccgtcgcctggcgcaccgccaccctcatcctcgccgtcatctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccttcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggccaacgtcaagaaggacctcatctcctacggcggcggctggaagctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcgtcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgtcgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcgtcgcctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccttctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatccgccgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagcgcccccgcctctgcacccgcgaggagttcatcaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccctacctcctcgagaagaaggtcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtgggccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcaacgaggagttcctcgactacatgccctccatgaagcgcttccgcaaggaggaggagtccgagggcgccatctggtga

SEQ ID NO: 13046 - RNA, 9873 nt, synthetic construct
  misc_feature 1..9873: note = derived and/or modified CDS sequence (opt2) from DENV-3__AY744683__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccttccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacgtcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagtccatcgagggcaaggccgtccagcacgagaacctcaagtacaccgtcatcatcaccgtccacaccggcgaccagcaccaggtcggcaacgagacccagggcgtcaccgccgagatcaccccccaggcctccaccgtcgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaacaagaaggagctcctcgtcaccttcaagaacgcccacgccaagaagcaggaggtcgtcgtcctcggctcccaggagggcgccatgcacaccgccctcaccggcgccaccgagatccagacctccggcggcacctccatcttcgccggccacctcaagtgccgcctcaagatggacaagctcgagctcaagggcatgtcctacgccatgtgcctcaacgccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccatcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccatcgtcgtcggcgacgtcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgagatgtacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggccgacaacttcaccatgggcgtcctctgcctcgccatcctcttcgaggaggtcatgcgcggcaagttcggcaagaagcacatgatcgccggcgccctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcgtctccctcatgtgctccaacaccatcttcaccctcaccgtcgcctggcgcaccgccaccctcatcctcgccgtcatctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccttcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggccaacgtcaagaaggacctcatctcctacggcggcggctggaagctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcgtcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgtcgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcgtcgcctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccttctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatccgccgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagcgcccccgcctctgcacccgcgaggagttcatcaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctcctcgagaagaaggtcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtgggccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcaacgaggagttcctcgactacatgccctccatgaagcgcttccgcaaggaggaggagtccgagggcgccatctggtga

SEQ ID NO: 13047 - RNA, 9873 nt, synthetic construct
  misc_feature 1..9873: note = derived and/or modified CDS sequence (opt2) from DENV-3__AY744684__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccttccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacgtcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagtccatcgagggcaaggccgtccagcacgagaacctcaagtacaccgtcatcatcaccgtccacaccggcgaccagcaccaggtcggcaacgagacccagggcgtcaccgccgagatcaccccccaggcctccaccgtcgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaacaagaaggagctcctcgtcaccttcaagaacgcccacgccaagaagcaggaggtcgtcgtcctcggctcccaggagggcgccatgcacaccgccctcaccggcgccaccgagatccagacctccggcggcacctccatcttcgccggccacctcaagtgccgcctcaagatggacaagctcgagctcaagggcatgtcctacgccatgtgcctcaacgccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccatcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccatcgtcgtcggcgacgtcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgagatgtacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggccgacaacttcaccatgggcgtcctctgcctcgccatcctcttcgaggaggtcatgcgcggcaagttcggcaagaagcacatgatcgccggcgccctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcgtctccctcatgtgctccaacaccatctccaccctcaccgtcgcctggcgcaccgccaccctcatcctcgccgtcatctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccttcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggccaacgtcaagaaggacctcatctcctacggcggcggctggaagctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcgtcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgtcgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcgtcgcctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccttctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatccgccgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagcgcccccgcctctgcacccgcgaggagttcatcaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctcctcgagaagaaggtcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtgggccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcaacgaggagttcctcgactacatgccctccatgaagcgcttccgcaaggaggaggagtccgagggcgccatctggtga

SEQ ID NO: 13048 - RNA, 9873 nt, synthetic construct
  misc_feature 1..9873: note = derived and/or modified CDS sequence (opt2) from DENV-3__AY744685__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccttccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacgtcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagtccatcgagggcaaggccgtccagcacgagaacctcaagtacaccgtcatcatcaccgtccacaccggcgaccagcaccaggtcggcaacgagatgcagggcgtcaccgccgagatcaccccccaggcctccaccgtcgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaacaagaaggagctcctcgtcaccttcaagaacgcccacgccaagaagcaggaggtcgtcgtcctcggctcccaggagggcgccatgcacaccgccctcaccggcgccaccgagatccagacctccggcggcacctccatcttcgccggccacctcaagtgccgcctcaagatggacaagctcgagctcaagggcatgtcctacgccatgtgcctcaacgccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccatcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacgcctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccatcgtcgtcggcgacgtcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgccctccgcgcctggaacgtctgggaggtcgaggactacggcttcggcgtcttcaccaccaacatctggctcaagctccgcgagaagtacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcatccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaagaccgacaacttcaccatgggcgtcctctgcctcgccatcctcttcgaggaggtcatgcgcggcaagttcggcaagaagcacatgatcgccggcgccctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcatgtgctccaacaccatcttcaccctcaccgtcgcctggcgcaccgccaccctcatcctcgccgtcatctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccttcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggccaacgtcaagaaggacctcatctcctacggcggcggctggaagctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcgtcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgtcgcctccgccgcccagcgccgcggccgcgtcggccgcaactcccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcgtcgcctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccttctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatccgccgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagcgcccccgcctctgcacccgcgaggagttcatcaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcccactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctcctcgagaagaaggtcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtgggccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcaacgaggagttcctcgactacatgccctccatgaagcgcttccgcaaggaggaggagtccgagggcgccatctggtga

SEQ ID NO: 13049 - RNA, 9873 nt, synthetic construct
  misc_feature 1..9873: note = derived and/or modified CDS sequence (opt2) from DENV-3__AY876494__SS-prME
  source 1..9873: mol_type = other RNA
acctccctctgcctcatgatgatgctccccgccaccctcgccttccacctcacctcccgcgacggcgagccccgcatgatcgtcgccaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccccgtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacgtcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagcacgagaacctcaagtacaccgtcatcatcaccgtccacaccggcgaccagcaccaggtcggcaacgacacccagggcgtcaccgtcgagatcaccccccaggcctccaccgccgaggccatcctccccgagtacggcaccctcgtcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctactacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcaccggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatccccaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagcgcccccgcctctgcacccgcgaggagttcaccaagaaggtccgcaccaacgccgccatgggcgccgtcttcaccgaggagaaccagtgggactccgcccgcgccgccgtcgaggacgaggagttctggaacctctgggaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcaccccctggctcgagcccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgctccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 13050 - RNA, 9873 nt, synthetic construct
  misc_feature 1..9873: note = derived and/or modified CDS sequence (opt2) from DENV-3__AY923865__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccggctcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagccccaggtcggcaacgacacccagggcgtcaccgtcgagatcaccccccaggcctccaccgtcgaggccgtcctcctcgagtacggcaccctcggcctcaagtgctccccccgcaccggcctcgacttcaacgagatgatcctcctcaccatgaagaccaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcctcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcaccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 13051 - RNA, 9867 nt, synthetic construct
  misc_feature 1..9867: note = derived and/or modified CDS sequence (opt2) from DENV-4__KR922405__SS-prME
  source 1..9867: mol_type = other RNA
tccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccgcctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcatcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcatcaagaccaccgccaaggaggtcgccctcctccgcacctactgcatcgaggcctccatctccaacatcaccaccgccacccgctgccccacccagggcgagccctacctcaaggaggagcaggaccagcagtacatctgccgccgcgacatggtcgaccgcggctggggcaacggctgcggcctcttcggcaagggcggcgtcgtcacctgcgccaagttctcctgcctcggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaccaagacctggctcgtccacaagcagtggttcctcgacctccccctcccctggaccaccggcgccgacaccctcgaggtccactggaaccacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcaccggcgccccctgcaaggtccccatcgagatccgcgacgtcaacaaggagaaggtcgtcggccgcatcatctcctccacccccttcgccgagaacaccaactccgtcaccaacatcgagctcgagccccccttcggcgactcctacatcgtcatcggcgtcggcgactccgccctcaccctccactggttccgcaagggctcctccatcggcaagatgttcgagtccacctaccgcggcgccaagcgcatggccatcctcggcgagaccgcctgggacttcggctccgtcggcggcctcctcacctccctcggcaaggccgtccaccaggtcttcggctccgtctacaccaccatgttcggcggcgtctcctggatggtccgcatcctcatcggcctcctcgtcctctggatcggcaccaactcccgcaacacctccatggccatgtcctgcatcgccgtcggcggcatcaccctcttcctcggcttcaccgtccacgccgacatgggctgcgtcgtctcctggtccggcaaggagctcaagtgcggctccggcatcttcgtcatcgacaacgtccacacctggaccgagcagtacaagttccagcccgagtcccccgcccgcctcgcctccgccatcctcaacgcccacaaggagggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctctccaagggcaagcgcgccctcgccccccccgtcaacgacctcaagtactcctggaagacctggggcaaggccaagatcttcacccccgagacccgcaactccaccttcctcgtcgacggccccgacacctccgagtgccccaacgagcgccgcgcctggaacttcctcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagaaggcctccctcatcgaggtcaagacctgcctctggcccaagacccacaccctctggtccaacggcgtcctcgagtcccagatgctcatccccaaggcctacgccggccccatctcccagcacaactaccgccagggctacgccacccagaccgccggcccctggcacctcggcaagctcgagatcgacttcggcgagtgccccggcaccaccgtcaccatccaggaggactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctcaacgagaaggaggagaacatggtcaagtcccaggtctccgccggccagggcacctccgagaccttctccatgggcctcctctgcctcaccctcttcgtcgaggagtgcctccgccgccgcgtcacccgcaagcacatgatcctcgtcgtcgtcaccaccctctgcgccatcatcctcggcggcctcacctggatggacctcctccgcgccctcatcatgctcggcgacaccatgtccggccgcatgggcggccagatccacctcgccatcatggccgtcttcaagatgtcccccggctacgtcctcggcatcttcctccgcaagctcacctcccgcgagaccgccctcatggtcatcggcatggccatgaccaccgtcctctccatcccccacgacctcatggagttcatcgacggcatctccctcggcctcatcctcctcaagatggtcacccacttcgacaacacccaggtcggcaccctcgccctcgccctcaccttcatcaagtccaccatgcccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctccaagcgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccgtcaccatgaccctctggtacatgtggcaggtcaagacccagcgctccggcgccctctgggacgtcccctcccccgccgccgcccagaaggccaccctcaccgagggcgtctaccgcatcatgcagcgcggcctcttcggcaagacccaggtcggcgtcggcatccacaccgagggcgtcttccacaccatgtggcacgtcacccgcggctccgtcatctgccacgagtccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcaccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctccgcaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgccccaagtggctcgacgcccgcgtctacgccgaccccatggccctcaaggacttcaaggagttcgcctccggccgcaagtccatcaccctcgacatcctcaccgagatcgcctccctccccatgtacctctcctcccgcgccaagctcgccctcgacaacatcgtcatgctccacaccaccgagcgcggcggcaaggcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcgccatcgccgtcgcctccggcctcctctgggtcgccgagatccagccccagtggatcgccgcctccatcatcctcgagttcttcctcatggtcctcctcgtccccgagcccgagaagcagcgcaccccccaggacaaccagctcatctacgtcatcctcaccatcctcaccatcatcgccctcgtcgccgccaacgagatgggcctcatcgagaagaccaagaccgacttcggcttctaccaggtcaaggccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagttcgccgtctcccgcggcacctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccgtccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgccgccacggcggctccctcgtccgctgccccctctcccgcaactccacccacgagatgtactgggtctccggcgtctccggcaacatcgtctcctccgtcaacaccacctccaagatgctcctcaaccgcttcaccacccgccaccgcaagcccacctacgagaaggacgccgacctcggcgccggcacccgctccgtctccaccgagaccgagaagcccgacatgaccatcatcggccgccgcctccagcgcctccaggaggagcacaaggagacctggcactacgaccacgagaacccctaccgcacctgggcctaccacggctcctacgaggccccctccaccggctccgcctcctccatggtcaacggcgtcgtcaagctcctcaccaagccctgggacgtcgtccccatggtcacccagctcgccatgaccgacaccacccccttcggccagcagcgcgtcttcaaggagaaggtcgacacccgcaccccccagcccaagcccggcacccgcgtcatcatgaccaccaccgccaactggctctggaccctcctcggccgcaagaagaacccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggacatcgacaagaaggacggcgacctcatctacgccgacgacaccgccggctgggacacccgcatcaccgaggacgacctcctcaacgaggagctcatcaccgagcagatggccccccaccacaagatcctcgccaaggccatcttcaagctcacctaccagaacaaggtcgtcaaggtcctccgccccacccccaagggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcacaaccccaagggcctcaaggagcgcgtcgagaagtggctcaaggagtgcggcgtcgaccgcctcaagcgcatggccatctccggcgacgactgcgtcgtcaagcccctcgacgagcgcttctccacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgatcgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgccatgcgccgctactccgcccacttcgagtccgagggcgtcctctga

SEQ ID NO: 13052 - RNA, 9867 nt, synthetic construct
  misc_feature 1..9867: note = derived and/or modified CDS sequence (opt2) from DENV-4__KP188557__SS-prME
  source 1..9867: mol_type = other RNA
tccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggccctcatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccaccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctccgccacccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggtccggccgcgagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgcctccgacctcaagtactcctggaagacctggggcaaggcccgcatcttcacccccgaggcccgcaacaacaccttcctcatcgacggccccgacacctccgagtgccccaacgagcgccgcgcctggaactccttcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagcgcgcctccctcatcgaggtcaagacctgcctctggcccaagacccacaccctctggtccaacggcgtcctcgagtcccagatgctcatccccaagtcctacgccggccccttctcccagcacaactaccgccagggctacgccacccagaccgtcggcccctggcacctcggcaagctcgagatcgacttcggcgagtgccccggcaccaccgtcaccatccaggagaactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcaccgccggccagggcacctccgagaccttctccatgggcctcctctgcctcaccctcttcgtcgaggagtgcctccgccgccgcgtcacccgcaagcacatgatcctcgccgtcgtcatcaccctctgcgccatcatcctcggcggcctcacctggatggacctcctccgcgccctcatcatgctcggcgacaccatgtccggccgcatcggcggccagacccacctcgccatcatggccgtcttcaagatgtcccccggctacgtcctcggcgtcttcctccgcaagctcacctcccgcgagaccgccctcatggtcatcggcatggccatgaccaccaccctctccatcccccacgacctcatggagctcatcgacggcatctccctcggcctcatcctcctcaagatcgtcacccagttcgacaacacccaggtcggcaccctcgccctctccctcaccttcatccgctccaccatgtccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccgctgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccatcaccatgaccctctggtacatgtggcaggtcaagacccagcgctccggcgccctctgggacgtcccctcccccgccgccacccagaaggccgccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacgcccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgccccaagtggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcaccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccgccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagcacgccgtctcccgcggctcctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgcaagcacggcggcaacctcgtccgctgccccctctcccgcaactccacccacgagatgtactgggtctccggcgcctccggcaacatcgtctcctccgtcaacaccacctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatggtcatgaccaccaccgccaactggctctgggccctcctcggcaagaagaagaacccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggagatcgacaagaaggacggcgacctcatgtacgccgacgacaccgccggctgggacacccgcatcaccgaggacgacctccagaacgaggagctcatcaccgagcagatggccccccaccacaagatcctcgccaaggccatcttcaagctcacctaccagaacaaggtcgtcaaggtcctccgccccaccccccgcggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctccgcgagtgcggcgtcgaccgcctcaagcgcatggccatctccggcgacgactgcgtcgtcaagcccctcgacgagcgcttcggcacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgatcgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgtcatgaagcgctactccgccccctccgagtccgagggcgtcctctga

SEQ ID NO: 13053 - RNA, 9867 nt, synthetic construct
  misc_feature 1..9867: note = derived and/or modified CDS sequence (opt2) from DENV-4__KP188558__SS-prME
  source 1..9867: mol_type = other RNA
tccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggccctcatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacgacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccaccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctccgccacccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggtccggccgcgagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgcctccgacctcaagtactcctggaagacctggggcaaggccaagatcttcacccccgaggcccgcaactccaccttcctcatcgacggccccgacacctccgagtgccccaacgagcgccgcgcctggaactccttcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagcgcgcctccctcatcgaggtcaagacctgcctctggcccaagacccacaccctctggtccaacggcgtcctcgagtcccagatgctcatccccaagtcctacgccggccccttctcccagcacaactaccgccagggctacgccacccagaccgtcggcccctggcacctcggcaagctcgagatcgacttcggcgagtgccccggcaccaccgtcaccatccaggagaactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcaccgccggccagggcacctccgagaccttctccatgggcctcctctgcctcaccctcttcgtcgaggagtgcctccgccgccgcgtcacccgcaagcacatgatcctcgccgtcgtcatcaccctctgcgccatcatcctcggcggcctcacctggatggacctcctccgcgccctcatcatgctcggcgacaccatgtccggccgcatcggcggccagacccacctcgccatcatggccgtcttcaagatgtcccccggctacgtcctcggcgtcttcctccgcaagctcacctcccgcgagaccgccctcatggtcatcggcatggccatgaccaccaccctctccatcccccacgacctcatggagctcatcgacggcatctccctcggcctcatcctcctcaagatcgtcacccagttcgacaacacccaggtcggcaccctcgccctctccctcaccttcatccgctccaccatctccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccatcaccatgaccctctggtacatgtggcaggtcaagacccagcgctccggcgccctctgggacgtcccctcccccgccgccacccagaaggccgccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgccccaagtggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcaccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccgccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagcacgccgtctcccgcggctcctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgcaagcacggcggcaacctcgtccgctgccccctctcccgcaactccacccacgagatgtactgggtctccggcgcctccggcaacatcgtctcctccgtcaacaccacctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatggtcatgaccaccaccgccaactggctctgggccctcctcggcaagaagaagaacccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggagatcgacaagaaggacggcgacctcatgtacgccgacgacaccgccggctgggacacccgcatcaccgaggacgacctccagaacgaggagctcatcaccgagcagatggccccccaccacaagatcctcgccaaggccatcttcaagctcacctaccagaacaaggtcgtcaaggtcctccgccccaccccccgcggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctccgcgagtgcggcgtcgaccgcctcaagcgcatggccatctccggcgacgactgcgtcgtcaagcccctcgacgagcgcttcggcacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgatcgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgtcatgaagcgctactccgccccctccgagtccgagggcgtcctctga

SEQ ID NO: 13054 - RNA, 9867 nt, synthetic construct
  misc_feature 1..9867: note = derived and/or modified CDS sequence (opt2) from DENV-4__KP188563__SS-prME
  source 1..9867: mol_type = other RNA
tccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggccctcatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccaccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctccgccacccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggtccggccgcgagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgcctccgacctcaagtactcctggaagacctggggcaaggccaagatcttcacccccgaggcccgcaactccaccttcctcatcgacggccccgacacctccgagtgccccaacgagcgccgcgcctggaactccttcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagcgcgcctccctcatcgaggtcaagacctgcctctggcccaagacccacaccctctggtccaacggcgtcctcgagtcccagatgctcatccccaagtcctacgccggccccttctcccagcacaactaccgccagggctacgccacccagaccgtcggcccctggcacctcggcaagctcgagatcgacttcggcgagtgccccggcaccaccgtcaccatccaggagaactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcaccgccggccagggcacctccgagaccttctccatgggcctcctctgcctcaccctcttcgtcgaggagtgcctccgccgccgcgtcacccgcaagcacatgatcctcgccgtcgtcatcaccctctgcgccatcatcctcggcggcctcacctggatggacctcctccgcgccctcatcatgctcggcgacaccatgtccggccgcatcggcggccagacccacctcgccatcatcgccgtcttcaagatgtcccccggctacgtcctcggcgtcttcctccgcaagctcacctcccgcgagaccgccctcatggtcatcggcatggccatgaccaccaccctctccatcccccacgacctcatggagctcatcgacggcatctccctcggcctcatcctcctcaagatcgtcacccagttcgacaacacccaggtcggcaccctcgccctctccctcaccttcatccgctccaccatgtccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccatcaccatgaccctctggtacatgtggcaggtcaagacccagcgctccggcgccctctgggacgtcccctcccccgccgccacccagaaggccgccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggaccgcgaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgccccaagtggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcaccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccgccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagcacgccgtctcccgcggctcctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgcaagcacggcggcaacctcgtccgctgccccctctcccgcaactccacccacgagatgtactgggtctccggcgcctccggcaacatcgtctcctccgtcaacaccacctccaagatgctcctcaaccgcttcaccacccgccaccgcaagcccacctacgagaaggacgtcgacctcggcgccggcacccgctccgtctccaccgagatcgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatggtcatgaccaccaccgccaactggctctgggccctcctcggcaagaagaagaacccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggagatcgacaagaaggacggcgacctcatgtacgccgacgacaccgccggctgggacacccgcatcaccgaggacgacctccagaacgaggagctcatcaccgagcagatggccccccaccacaagatcctcgccaaggccatcttcaagctcacctaccagaacaaggtcgtcaaggtcctccgccccaccccccgcggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctccgcgagtgcggcgtcgaccgcctcaagcgcatggccatctccggcgacgactgcgtcgtcaagcccctcgacgagcgcttcggcacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgatcgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgtccgtcatgaagcgctactccgccccctccgagtccgagggcgtcctctga

SEQ ID NO: 13055 - RNA, 9867 nt, synthetic construct
  misc_feature 1..9867: note = derived and/or modified CDS sequence (opt2) from DENV-4__KP188564__SS-prME
  source 1..9867: mol_type = other RNA
tccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatcgcccagggcaagcccaccctcgacttcgagctcaccaagaccaccgccaaggaggtcgccctcctccgcacctactgcatcgaggccctcatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccaccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaagatcaagtacgagggcgccggcgccccctgcaaggtccccatcgagatccgcgacgtcaacaaggagaaggtcgtcggccgcgtcatctccgccacccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggtccggccgcgagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgcctccgacctcaagtactcctggaagacctggggcaaggccaagatcttcacccccgaggcccgcaactccaccttcctcatcgacggccccgacacctccgagtgccccaacgagcgccgcgcctggaactccttcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagcgcgcctccctcatcgaggtcaagacctgcctctggcccaagacccacaccctctggtccaacggcgtcctcgagtcccagatgctcatccccaagtcctacgccggccccttctcccagcacaactaccgccagggctacgccacccagaccgtcggcccctggcacctcggcaagctcgagatcgacttcggcgagtgccccggcaccaccgtcaccatccaggagaactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcaccgccggccagggcacctccgagaccttctccatgggcctcctctgcctcaccctcttcgtcgaggagtgcctccgccgccgcgtcacccgcaagcacatgatcctcgccgtcgtcatcaccctctgcgccatcatcctcggcggcctcacctggatggacctcctccgcgccctcatcatgctcggcgacaccatgtccggccgcatcggcggccagacccacctcgccatcatggccgtcttcaagatgtcccccggctacgtcctcggcgtcttcctccgcaagctcacctcccgcgagaccgccctcatggtcatcggcatggccatgaccaccaccctctccatcccccacgacctcatggagctcatcgacggcatctccctcggcctcatcctcctcaagatcgtcacccagttcgacaacacccaggtcggcaccctcgccctctccctcaccttcatccgctccaccatgtccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccatcaccatgaccctctggtacatgtggcaggtcaagacccagcgctccggcgccctctgggacgtcccctcccccgccgccacccagaaggccgccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgccccaagtggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcaccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccttctgcgaggtcctcaccctcgccaccggccccaccctcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccgccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagcacgccgtctcccgcggctcctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgcaagcacggcggcaacctcgtccgctgccccctctcccgcaactccacccacgagatgtactgggtctccggcgcctccggcaacatcgtctcctccgtcaacaccacctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatggtcatgaccaccaccgccaactggctctgggccctcctcggcaagaagaagaacccccgcctctgcacccgcgaggagttcatctccaaggtccgctccaacgccgccatcggcgccgtcttccaggaggagcagggctggacctccgccaacgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggagatcgacaagaaggacggcgacctcatgtacgccgacgacaccgccggctgggacacccgcatcaccgaggacgacctccagaacgaggagctcatcaccgagcagatggccccccaccacaagatcctcgccaaggccatcttcaagctcacctaccagaacaaggtcgtcaaggtcctccgccccaccccccgcggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctccgcgagtgcggcgtcgaccgcctcaagcgcatggccatctccggcgacgactgcgtcgtcaagcccctcgacgagcgcttcggcacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgatcgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgtcatgaagcgctactccgccccctccgagtccgagggcgtcctctga

SEQ ID NO: 13056 - RNA, 9867 nt, synthetic construct
  misc_feature 1..9867: note = derived and/or modified CDS sequence (opt2) from DENV-4__JN983813__SS-prME
  source 1..9867: mol_type = other RNA
tccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggccctcatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccaccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctccgccacccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggtccggccgcgagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgcctccgacctcaagtactcctggaagacctggggcaaggccaagatcttcacccccgaggcccgcaactccaccttcctcatcgacggccccgacacctccgagtgccccaacgagcgccgcgcctggaactccttcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagcgcgcctccctcatcgaggtcaagacctgcctctggcccaagacccacaccctctggtccaacggcgtcctcgagtcccagatgctcatccccaagtcctacgccggccccttctcccagcacaactaccgccagggctacgccacccagaccgtcggcccctggcacctcggcaagctcgagatcgacttcggcgagtgccccggcaccaccgtcaccatccaggagaactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcaccgccggccagggcacctccgagaccttctccatgggcctcctctgcctcaccctcttcgtcgaggagtgcctccgccgccgcgtcacccgcaagcacatgatcctcgccgtcgtcatcaccctctgcgccatcatcctcggcggcctcacctggatggacctcctccgcgccctcatcatgctcggcgacaccatgtccggccgcatcggcggccagacccacctcgccatcatggccgtcttcaagatgtcccccggctacgtcctcggcgtcttcctccgcaagctcacctcccgcgagaccgccctcatggtcatcggcatggccatgaccaccaccctctccatcccccacgacctcatggagctcatcgacggcatctccctcggcctcatcctcctcaagatcgtcacccagttcgacaacacccaggtcggcaccctcgccctctccctcaccttcatccgctccaccatgtccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccatcaccatgaccctctggtacatgtggcaggtcaagacccagcgctccggcgccctctgggacgtcccctcccccgccgccacccagaaggccgccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaaccgcaagggcaaggtcatcggcctctacggcaacggcgtcgtcaccaagtccggcgactacatctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgccccaagtggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcaccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccgccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagcacgccgtctcccgcggctcctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgcaagcacggcggcaacctcgtccgctgccccctctcccgcaactccacccacgagatgtactgggtctccggcgcctccggcaacatcgtctcctccgtcaacaccacctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatggtcatgaccaccaccgccaactggctctgggccctcctcggcaagaagaagaacccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggagatcgacaagaaggacggcgacctcatgtacgccgacgacaccgccggctgggacacccgcatcaccgaggacgacctccagaacgaggagctcatcaccgagcagatggccccccaccacaagatcctcgccaaggccatcttcaagctcacctaccagaacaaggtcgtcaaggtcctccgccccaccccccgcggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctccgcgagtgcggcgtcgaccgcctcaagcgcatggccatctccggcgacgactgcgtcgtcaagcccctcgacgagcgcttcggcacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgatcgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgtcatgaagcgctactccgccccctccgagtccgagggcgtcctctga

SEQ ID NO: 13057 - RNA, 9867 nt, synthetic construct
  misc_feature 1..9867: note = derived and/or modified CDS sequence (opt2) from DENV-4__KF041260__SS-prME
  source 1..9867: mol_type = other RNA
tccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccgcctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcatcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcatcaagaccaccgccaaggaggtcgccctcctccgcacctactgcatcgaggcctccatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcatccagatcgagaacctcgagtacaccgtcgtcgtcaccgtccacaacggcgacacccacgccgtcggcaacgacacctccaaccacggcgtcaccgccaccgtcaccccccgctccccctccgtcgaggtcgagctccccgactacggcgagctcaccctcgactgcgagccccgctccggcatcgacttcaacgagatgatcctcatgaagatgaacaagaagacctggctcgtccacaagcagtggttcctcgacctccccctcccctggaccgccggcgccgacacctccgaggtccactggaaccacaaggagcgcatggtcaccttcaaggtcccccacgccaagcgccaggacgtcaccgtcctcggctcccaggagggcgccatgcactccgccctcaccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcatcatctcctccacccccttcgccgagaacaccaactccgtcaccaacatcgagctcgagccccccttcggcgactcctacatcgtcatcggcgtcggcgactccgccctcaccctccactggttccgcaagggctcctccatcggcaagatgttcgagtccacctaccgcggcgccaagcgcatggccatcctcggcgagaccgcctgggacttcggctccgtcggcggcctcctcacctccctcggcaaggccgtccaccaggtcttcggctccgtctacaccaccatgttcggcggcgtctcctggatggtccgcatcctcatcggcttcctcgtcctctggatcggcaccaactcccgcaacacctccatggccatgtcctgcatcgccgtcggcggcatcaccctcttcctcggcttcaccgtccacgccgacatgggctgcgccgtctcctggtccggcaaggagctcaagtgcggctccggcatcttcatcatcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctctccaagggcaagcgcgccctcgccccccccgtcaacgacctcaagtactcctggaagacctggggcaaggccaagatcttcacccccgagacccgcaactccaccttcctcatcgacggccccgacacctccgagtgccccaacgagcgccgcgcctggaacttcctcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagaaggcctccctcatcgaggtcaagacctgcctctggcccaagacccacaccctctggtccaacggcgtcctcgagtcccagatgctcatccccaaggcctacgccggccccttctcccagcacaactaccgccagggctacgccacccagaccatgggcccctggcacctcggcaagctcgagatcgacttcggcgagtgccccggcaccaccgtcaccatccaggaggactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtctccgccggccagggcacctccgagaccttctccatgggcctcctctgcctcaccctcttcgtcgaggagtgcctccgccgccgcgtcacccgcaagcacatgatcctcgtcgtcgtcaccaccctctgcgccatcatcctcggcggcctcacctggatggacctcctccgcgccctcatcatgctcggcaacaccatgtcctcccgcatgggcggccagacccacctcgccatcatggccgtcttcaagatgtcccccggctacgtcctcggcatcttcctccgcaagctcacctcccgcgagaccgccctcatggtcatcggcatggccatgaccaccgtcctctccatcccccacgacctcatggagttcatcgacggcatctccctcggcctcatcctcctcaagatggtcacccacttcgacaacacccaggtcggcaccctcgccctctccctcaccttcatcaagtccaccatgcccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctccaagcgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaccgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccgtcaccatgaccctctggtacatgtggcaggtcaagacccagcgctccggcgccctctgggacgtcccctcccccgccgccacccagaaggccaccctcaccgagggcgtctaccgcatcatgcagcgcggcctcttcggcaagacccaggtcggcgtcggcatccacatggagggcgtcttccacaccatgtggcacgtcacccgcggctccgtcatctgccacgagtccggccgcctcgagccctcctgggccgacgtcaagaacgacatgatctcctacggcggcggctggcgcctcggcgacaagtgggacaaggaggaggacgtccaggtcctcgccgtcgagcccggcaagaaccccaagcacgtccagaccaagcccggcctcttcaagaccctcaccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagaccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcaccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcgtccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcatcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctccgcaacgacgaggaccacgcccactggaccgaggccaagatgctcctcgacaacatccacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgccccaagtggctcgacgcccgcgtctacgccgaccccgtcgccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggcaaggcctaccagcacgccctcaacgagctccccgagtccctcgagaccctcatgctcgtcgccctcctcggcgccatgaccgccggcatcttcctcttcttcatgcagggcaagggcatgggcaagctctccatgggcctcatcgccatcgccgtcgcctccggcctcctctgggtcgccgagatccagccccagtggatcgccgcctccatcatcctcgagttcttcctcatggccctcctcatccccgagcccgagaagcagcgcaccccccaggacaaccagctcatctacgtcatcctcaccatcctcaccatcatcggcctcgtcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgccttctccctcatcaagaacacccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagtacgccgtctcccgcggcacctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgcaagcacggcggctccctcgtccgctgccccctctcccgcaactccacccacgagatgtactgggtctccggcgtctccggcaacatcgtctcctccgtcaacaccacctccaagatgctcctcaaccgcttcaccacccgctaccgcaagcccacctacgagaaggacgccgacctcggcgccggcacccgctccgtctccaccgagaccgagaagcccgacatggccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatgatcatgaccaccaccgccaactggctctgggccctcctcggcaagaagaagaacccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggacatcgacaagaaggacggcgacctcatctacgccgacgacaccgccggctgggacacccgcatcaccgaggacgacctcctcaacgaggagctcatcaccgagcagatggccccccaccacaagatcctcgccaaggccatcttcaagctcacctaccagaacaaggtcgtcaaggtcctccgccccacccccaagggcgccgtcatggacatcatctcccgcaaggaccagcgcggctccggccaggtcggcacctacggcctcaacaccttcaccaacatggaggtccagctcatccgccagatggaggccgagggcgtcatcacccgcgacgacatgcacaaccccaagggcctcaaggagcgcgtcgagaagtggctcaaggagtgcggcgtcgaccgcctcaagcgcatggccatctccggcgacgactgcgtcgtcaagcccctcgacgagcgcttctccacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgaccgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgtcatgaagcgctactccgcccccttcgagtccgagggcgtcctctga

SEQ ID NO: 13058 - RNA, 9867 nt, synthetic construct
  misc_feature 1..9867: note = derived and/or modified CDS sequence (opt2) from DENV-4__FJ024476__SS-prME
  source 1..9867: mol_type = other RNA
tccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcaccgccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggcctccatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccatgatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccgccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcatcatctcctccacccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcctcctcgtcctctggatcggcaccaactcccgcaacacctccatggccatgacctgcatcgccgtcggcggcatcaccctcttcctcggcttcaccgtccaggccgacatgggctgcgtcgtctcctggtccggcaaggagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgtctccgacctcaagtactcctggaagacctggggcaaggcccgcatcttcacccccgaggcccgcaactccaccttcctcatcgacggccccgacacctccgagtgccccaacgagcgccgcgcctggaactccctcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagcgcgcctccctcatcgaggtcaagacctgcctctggcccaagacccacaccctctggtccaacggcgtcctcgagtcccagatgctcatccccaagtcctacgccggccccttctcccagcacaactaccgccagggctacgccacccagaccatgggcccctggcacctcggcaagctcgagatcggcttcggcgagtgccccggcaccaccgtcaccatccaggaggactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagcgcgaggagaacatggtcaagtcccaggtcaccgccggccagggcacctccgagaccttctccatgggcctcctctgcctcaccctcttcgtcgaggagtgcctccgccgccgcgtcacccgcaagcacatgatcctcgtcgtcgtcatcaccctctgcgccatcatcctcggcggcctcacctggatggacctcctccgcgccctcatcatgctcggcgacaccatgtccggccgcatcggcggccagatccacctcgccatcatggccgtcttcaagatgtcccccggctacgtcctcggcgtcttcctccgcaagctcacctcccgcgagaccgccctcatggtcatcggcatggccatgaccaccgtcctctccatcccccacgacctcatggagctcatcgacggcatctccctcggcctcatcctcctcaagatcgtcacccagttcgacaacacccaggtcggcaccctcgccctctccctcaccttcatccgctccaccatgcccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccgtcaccatgaccctctggtacatgtggcaggtcaagacccagcgctccggcgccctctgggacgtcccctcccccgccgccacccagaaggccgccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcgtccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgcccccgctggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcaccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagcacgccgtctcccgcggctcctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgcaagcacggcggcaacctcgtccgctgccccctctcccgcaactccacccacgagatgtactgggtctccggcgcctccggcaacatcgtctcctccgtcaacaccacctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatggtcatgaccaccaccgccaactggctctgggccctcctcggcaagaagaagaacccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggagatcgacaagaaggacggcgacctcatgtacgccgacgacaccgccggctgggacacccgcatcaccgaggacgacctccagaacgaggagctcatcaccgagcagatggccccccaccacaagatcctcgccaaggccatcttcaagctcacctaccagaacaaggtcgtcaaggtcctccgccccaccccccgcggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctccgcgagcgcgtcgagaagtggctcaaggagtgcggcgtcgaccgcctcaagcgcatggccatctccggcgacgactgcgtcgtcaagcccctcgacgagcgcttcggcacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgaccgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgtcatgaagcgctactccgccccctccgagtccgagggcgtcctctga

SEQ ID NO: 13059 - RNA, 9867 nt, synthetic construct
  misc_feature 1..9867: note = derived and/or modified CDS sequence (opt2) from DENV-4__GQ868579__SS-prME
  source 1..9867: mol_type = other RNA
tccaccatcaccctcctctgcctcatccccaccatcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcatcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcatcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggccctcatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccgccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctcctccacccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccgcgccgacatgggctgcgtcgtctcctggtccggccgcgagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgtctccgacctcaagtactcctggaagacctggggcaaggccaagatcttcacccccgaggcccgcaactccaccttcctcatcgacggccccgacacctccgagtgccccaacgagcgccgcgcctggaactccctcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagcgcgcctccctcatcgaggtcaagacctgcctctggcccaagacccacaccctctggtccaacggcgtcctcgagtcccagatgctcatccccaagtcctacgccggccccttctcccagcacaactaccgccagggctacgccacccagaccgtcggcccctggcacctcggcaagctcgagatcgacttcggcgagtgccccggcaccaccgtcaccatccaggaggactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcaccgccggccagtccacctccgagaccttctccatgggcctcctctgcctcaccctcttcgtcgaggagtgcctccgccgccgcgtcacccgcaagcacatgatcctcgccgtcgtcatcaccctctgcgccatcatcctcggcggcctcacctggatggacctcctccgcgccctcatcatgctcggcgacaccatgtccggccgcatcggcggccagacccacctcgccatcatggccgtcttcaagatgtcccccggctacgtcctcggcgtcttcctccgcaagctcacctcccgcgagaccgccctcatggtcatcggcatggccatgaccaccaccctctccatcccccacgacctcatggagctcatcgacggcatctccctcggcctcatcctcctcaagatcgtcacccagttcgacaacacccaggtcggcaccctcgccctctccctcaccttcatccgctccaccatgtccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccgtcaccatgaccctctggtacatgtggcaggtcaagacccagcgctccggcgccctctgggacgtcccctcccccgccgccacccagaaggccgccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggaccgcgaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaacaagaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgcccccgctggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggccgcgcctaccagcacgccctcaacgagctccccgagtccctcgagaccctcatgctcgtcgccctcctcggcgccatgaccgccggcaccttcctcttcttcatgcagggcaagggcatcggcaagctctccatgggcctcatcaccatcgccatggcctccggcctcctctggatcgccgagatccagccccagtggatcgccgcctccatcatcctcgagttcttcctcatggtcctcctcatccccgagcccgagaagcagcgcaccccccaggacaaccagctcatctacgtcatcctcaccatcctcgccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgccttctccctcatcaagaacgcccaggccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagcacgccgtctcccgcggctcctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgcaagcacggcggcaacctcgtccgctgccccctctcccgcaactccacccacgagatgtactgggtctccggcgcctccggcaacatcgtctcctccgtcaacaccacctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatggtcatgaccaccaccgccaactggctctgggccctcctcggcaagaagaagtccccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggagatcgacaagaaggacggcgacctcatgtacgccgacgacaccgccggctgggacacccgcatcaccgaggacgacctccagaacgaggagctcatcaccgagcagatggccccccaccacaagatcctcgccaaggccatcttcaagctcacctaccagaacaaggtcgtcaaggtcctccgccccaccccccgcggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaactggctccgcgagtgcggcgtcgaccgcctcaagcgcatggccatctccggcgacgactgcgtcgtcaagcccctcgacgagcgcttcggcacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgatcgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgtcatgaagcgctactccgccccctccgagtccgagggcgtcctctga

SEQ ID NO: 13060 - RNA, 9867 nt, synthetic construct
  misc_feature 1..9867: note = derived and/or modified CDS sequence (opt2) from DENV-4__GQ868580__SS-prME
  source 1..9867: mol_type = other RNA
tccaccatcaccctcctctgcctcatccccaccatcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcatcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggccctcatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccgccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcatcatctcctccacccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggtccggccgcgagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgtctccgacctcaagtactcctggaagacctggggcaaggccaagatcttcacccccgaggcccgcaactccaccttcctcatcgacggccccgacacctccgagtgccccaacgagcgccgcgcctggaactccctcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagcgcgcctccctcatcgaggtcaagacctgcctctggcccaagacccacaccctctggtccaacggcgtcctcgagtcccagatgctcatccccaagtcctacgccggccccttctcccagcacaactaccgccagggctacgccacccagaccgtcggcccctggcacctcggcaagctcgagatcgacttcggcgagtgccccggcaccaccgtcaccatccaggaggactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctcaacgagaaggaggagaacatggtcaagtcccaggtcaccgccggccagtccacctccgagaccttctccatgggcctcctctgcctcaccctcttcgtcgaggagtgcctccgccgccgcgtcacccgcaagcacatgatcctcgccgtcgtcatcaccctctgcgccatcatcctcggcggcctcacctggatggacctcctccgcgccctcatcatgctcggcgacaccatgtccggccgcatcggcggccagacccacctcgccatcatggccgtcttcaagatgtcccccggctacgtcctcggcgtcttcctccgcaagctcacctcccgcgagaccgccctcatggtcatcggcatggccatgaccaccaccttctccatcccccacgacctcatggagctcatcgacggcatctccctcggcctcatcctcctcaagatcgtcacccagttcgacaacacccaggtcggcaccctcgccctctccctcaccttcatccgctccaccatgtccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccgtcaccatgaccctctggtacatgtggcaggtcaagacccagcgctccggcgccctctgggacgtcccctcccccgccgccacccagaaggccgccctctccgagggcgtctaccgcatcatgcagcgcggcctcctcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggaccgcgaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgcccccgctggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcaccatcgccatggcctccggcctcctctggatcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagcacgccgtctcccgcggctcctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgcaagcacggcggcaacctcgtccgctgccccctctcccgcaactccacccacgagatgtactgggtctccggcgcctccggcaacatcgtctcctccgtcaacaccacctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatggtcatgaccaccaccgccaactggctctgggccctcctcggcaagaagaagtccccccgcctctgcacccgcgaggagttcatctccaaggtccgctccaacgccgccatcggcgccgtcttccaggaggagcagggctggacctccgcctccgaggccgtctccgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggagatcgacaagaaggacggcgacctcatgtacgccgacgacaccgccggctgggacacccgcatcaccgaggacgacctccagaacgaggagctcatcaccgagcagatggccccccaccacaagatcctcgccaaggccatcttcaagctcacctaccagaacaaggtcgtcaaggtcctccgccccaccccccgcggcgccgtcatggacatcatctcccgcaaggaccagcgcggctccggccaggtcggcacctactccctcaacaccttcaccaacatggaggtccagctcatccgccagatggaggccgagggcgtcatcacccaggacgacatgcagaaccccaagggcctcaaggagcgcgtcgagaactggctccgcgagtgcggcgtcgaccgcctcaagcgcatggccatctccggcgacgactgcgtcgtcaagcccctcgacgagcgcttcggcacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgatcgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgtcatgaagcgctactccgccccctccgagtccgagggcgtcctctga

SEQ ID NO: 13061 - RNA, 9867 nt, synthetic construct
  misc_feature 1..9867: note = derived and/or modified CDS sequence (opt2) from DENV-4__GQ868583__SS-prME
  source 1..9867: mol_type = other RNA
tccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggccctcatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccaccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctccgccacccccctcgccgagaacaccaactccgtcaccaacatcgagctcgagccccccttcggcgactcctacatcatgatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggtccggccgcgagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcgccccccccgcctccgacctcaagtactcctggaagacctggggcaaggccaagatcttcacccccgaggcccgcaactccaccttcctcatcgacggccccgacacctccgagtgccccaacgagcgccgcgcctggaactccttcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagcgcgcctccctcatcgaggtcaagacctgcctctggcccaagacccacaccctctggtccaacggcgtcctcgagtcccagatgctcatccccaagtcctacgccggccccttctcccagcacaactaccgccagggctacgccacccagaccgtcggcccctggcacctcggcaagctcgagatcgacttcggcgagtgccccggcaccaccgtcaccatccaggaggactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcaccgccggccagggcacctccgagaccttctccatgggcctcctctgcctcaccctcttcgtcgaggagtgcctccgccgccgcgtcacccgcaagcacatgatcctcgccgtcgtcatcaccctctgcgccatcatcctcggcggcctcacctggatggacctcctccgcgccctcatcatgctcggcgacaccatgtccggccgcatcggcggccagacccacctcgccatcatggccgtcttcaagatgtcccccggctacgtcctcggcgtcttcctccgcaagctcacctcccgcgagaccgccctcatggtcatcggcatggccatgaccaccaccctctccatcccccacgacctcatggagctcatcgacggcatctccctcggcctcatcctcctcaagatcgtcacccagttcgacaacacccaggtcggcaccctcgccctctccctcaccttcatccgctccaccatgtccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccgtcaccatgaccctctggtacatgtggcaggtcaagacccagcgctccggcgccctctgggacgtcccctcccccgccgccacccagaaggccgccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgccccaagtggctcgacgcccgcgtctacgccgaccccatggccctccaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcaccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagcacgccgtctcccgcggctcctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgcaagcacggcggcaacctcgtccgctgccccctctcccgcaactccacccacgagatgtactgggtctccggcgcctccggcaacatcgtctcctccgtcaacaccacctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatggtcatgaccaccaccgccaactggctctgggccctcctcggcaagaagaagaacccccgcctctgcacccgcgaggagttcatctccaaggtccgctccaacgccgccatcggcgccgtcttccaggaggagcagggctggacctccgcctccgaggccgtctccgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggagatcgacaagaaggacggcgacctcatgtacgccgacgacaccgccggctgggacacccgcatcaccgaggacgacctccagaacgaggagctcatcaccgagcagatggccccccaccacaagatcctcgccaaggccatcttcaagctcacctaccagaacaaggtcgtcaaggtcctccgccccaccccccgcggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctccgcgagtgcggcgtcgaccgcctcaagcgcatggccatctccggcgacgactgcgtcgtcaagcccctcgacgagcgcttcggcacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgatcgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgtcatgaagcgctactccgccccctccgagtccgagggcgtcctctga

SEQ ID NO: 13062 - RNA, 9867 nt, synthetic construct
  misc_feature 1..9867: note = derived and/or modified CDS sequence (opt2) from DENV-4__GQ868584__SS-prME
  source 1..9867: mol_type = other RNA
tccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggccctcatctccaacatcaccaccgccacccgctgccccacccagggcgagccctacctcaaggaggagcaggaccgccagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccaccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctccgccacccccctcgccgagaacaccaactccgtcaccaacatcgagctcgagccccccttcggcgactcctacatcatgatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggtccggccgcgagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcgccccccccgcctccgacctcaagtactcctggaagacctggggcaaggccaagatcttcacccccgaggcccgcaactccaccttcctcatcgacggccccgacacctccgagtgccccaacgagcgccgcgcctggaactccttcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagcgcgcctccctcatcgaggtcaagacctgcctctggcccaagacccacaccctctggtccaacggcgtcctcgagtcccagatgctcatccccaagtcctacgccggccccttctcccagcacaactaccgccagggctacgccacccagaccgtcggcccctggcacctcggcaagctcgagatcgacttcggcgagtgccccggcaccaccgtcaccatccaggaggactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcaccgccggccagggcacctccgagaccttctccatgggcctcctctgcctcaccctcttcgtcgaggagtgcctccgccgccgcgtcacccgcaagcacatgatcctcgccgtcgtcatcaccctctgcgccatcatcctcggcggcctcacctggatggacctcctccgcgccctcatcatgctcggcgacaccatgtccggccgcatcggcggccagacccacctcgccatcatggccgtcttcaagatgtcccccggctacgtcctcggcgtcttcctccgcaagctcacctcccgcgagaccgccctcatggtcatcggcatggccatgaccaccaccctctccatcccccacgacctcatggagctcatcgacggcatctccctcggcctcatcctcctcaagatcgtcacccagttcgacaacacccaggtcggcaccctcgccctctccctcaccttcatccgctccaccatgtccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccgtcaccatgaccctctggtacatgtggcaggtcaagacccagcgctccggcgccctctgggacgtcccctcccccgccgccacccagaaggccgccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgccccaagtggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcaccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagcacgccgtctcccgcggctcctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgcaagcacggcggcaacctcgtccgctgccccctctcccgcaactccacccacgagatgtactgggtctccggcgcctccggcaacatcgtctcctccgtcaacaccacctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatggtcatgaccaccaccgccaactggctctgggccctcctcggcaagaagaagaacccccgcctctgcacccgcgaggagttcatctccaaggtccgctccaacgccgccatcggcgccgtcttccaggaggagcagggctggacctccgcctccgaggccgtctccgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggagatcgacaagaaggacggcgacctcatgtacgccgacgacaccgccggctgggacacccgcatcaccgaggacgacctccagaacgaggagctcatcaccgagcagatggccccccaccacaagatcctcgccaaggccatcttcaagctcacctaccagaacaaggtcgtcaaggtcctccgccccaccccccgcggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctccgcgagtgcggcgtcgaccgcctcaagcgcatggccatctccggcgacgactgcgtcgtcaagcccctcgacgagcgcttcggcacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgatcgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgtcatgaagcgctactccgccccctccgagtccgagggcgtcctctga

SEQ ID NO: 13063 - RNA, 9867 nt, synthetic construct
  misc_feature 1..9867: note = derived and/or modified CDS sequence (opt2) from DENV-4__GQ868585__SS-prME
  source 1..9867: mol_type = other RNA
tccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggccctcatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccaccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacgagaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctccgccacccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggtccggccgcgagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgcctccgacctcaagtactcctggaagacctggggcaaggccaagatcttcacccccgaggcccgcaactccaccttcctcatcgacggccccgacacctccgagtgccccaacgagcgccgcgcctggaactccttcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagcgcgcctccctcatcgaggtcaagacctgcctctggcccaagacccacaccctctggtccaacggcgtcctcgagtcccagatgctcatccccaagtcctacgccggccccttctcccagcacaactaccgccagggctacgccacccagaccgtcggcccctggcacctcggcaagctcgagatcgacttcggcgagtgccccggcaccaccgtcaccatccaggagaactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcaccgccggccagggcacctccgagaccttctccatgggcctcctctgcctcaccctcttcgtcgaggagtgcctccgccgccgcgtcacccgcaagcacatgatcctcgccgtcgtcatcaccctctgcgccatcatcctcggcggcctcacctggatggacctcctccgcgccctcatcatgctcggcgacaccatgtccggccgcatcggcggccagacccacctcgccatcatggccgtcttcaagatgtcccccggctacgtcctcggcgtcttcctccgcaagctcacctcccgcgagaccgccctcatggtcatcggcatggccatgaccaccaccctctccatcccccacgacctcatggagctcatcgacggcatctccctcggcctcatcctcctcaagatcgtcacccagttcgacaacacccaggtcggcaccctcgccctctccctcaccttcatccgctccaccatgtccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccatcaccatgaccctctggtacatgtggcaggtcaagacccagcgctccggcgccctctgggacgtcccctcccccgccgccacccagaaggccgccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgccccaagtggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcaccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagcacgccgtctcccgcggctcctccaagatccgctggatcgtcgagcgcggcatggtcaagcccaagggcaaggtcatcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgcaagcacggcggcaacctcgtccgctgccccctctcccgcaactccacccacgagatgtactgggtctccggcgcctccggcaacatcgtctcctccgtcaacaccacctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatggtcatgaccaccaccgccaactggctctgggccctcctcggcaagaagaagaacccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggagatcgacaagaaggacggcgacctcatgtacgccgacgacaccgccggctgggacacccgcatcaccgaggacgacctccagaacgaggagctcatcaccgagcagatggccccccaccacaagatcctcgccaaggccatcttcaagctcacctaccagaacaaggtcgtcaaggtcctccgccccaccccccgcggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctccgcgagtgcggcgtcgaccgcctcaagcgcatggccatctccggcgacgactgcgtcgtcaagcccctcgacgagcgcttcggcacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgatcgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgtcatgaagcgctactccgccccctccgagtccgagggcgtcctctga

SEQ ID NO: 13064 - RNA, 9867 nt, synthetic construct
  misc_feature 1..9867: note = derived and/or modified CDS sequence (opt2) from DENV-4__JQ922560__SS-prME
  source 1..9867: mol_type = other RNA
tccaccatcaccctcctctgcctcatccccaccgtcatggccttccacctctccacccgcgacggcgagcccctcatgatcgtcgccaagcacgagcgcggccgccgcctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccgcctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcatcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcatcaagaccaccgccaaggaggtcgccctcctccgcacctactgcatcgaggcctccatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgcaccggcaagatcaccggcaacctcatccagatcgagaacctcgagtacaccgtcgtcgtcaccgtccacaacggcgacacccacgccgtcggcaacgacacctccaaccacggcgtcaccgccaccatcaccccccgctccccctccgtcgaggtcgagctccccgactacggcgagctcaccctcgactgcgagccccgctccggcatcgacttcaacgagatgatcctcatgaagatgaacaagaagacctggctcgtccacaagcagtggttcctcgacctccccctcccctgggccgccggcgccgacacctccgaggtccactggaaccacaaggagcgcatggtcaccttcaaggtcccccacgccaagcgccaggacgtcaccgtcctcggctcccaggagggcgccatgcactccgccctcaccggcgccaccgaggtctactccggcgacggcaacctcatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctcctccacccccttcgccgagaacaccaactccgtcaccaacatcgagctcgagccccccttcggcgactcctacatcgtcatcggcgtcggcgactccgccctcaccctccactggttcaccaagggctcctccatcggcaagatgttcgagtccacctaccgcggcgccaagcgcatggccatcctcggcgagaccgcctgggacttcggctccgtcggcggcctcctcacctccctcggcaaggccgtccaccaggtcttcggctccgtctacaccaccatgttcggcggcgtctcctggatggtccgcatcctcatcggcttcctcgtcctctggatcggcaccaactcccgcaacacctccatggccatgtcctgcatcgccgtcggcggcatcaccctcttcctcggcttcaccgtccacgccgacatgggctgcgccgtctcctggtccggcaaggagctcaagtgcggctccggcatcttcatcatcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctctccaagggcaagcgcgccctcgccccccccgtcaacgacctcaagtactcctggaagacctggggcaaggccaagatcttcacccccgagacccgcaactccaccttcctcatcgacggccccgacacctccgagtgccccaacgagcgccgcgcctggaacttcctcgaggtcgaggactacggcttcggcatgttcaccaccaacatctggatgaagttccgcgagggctcctccgagatgtgcgaccaccgcctcatgtccgccgccatcaaggaccagaaggccgtccacgccgacatgggctactggatcgagtcctccaagaaccagacctggcagatcgagaaggcctccctcatcgaggtcaagacctgcctctggcccaagacccacaccctctggtccaacggcgtcctcgagtcccagatgctcatccccaaggcctacgccggccccttctcccagcacaactaccgccagggctacgccacccagaccgtcggcccctggcacctcggcaagctcgagatcgacttcggcgagtgccccggcaccaccgtcaccatccaggaggactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtctccgccggccagggcacctccgagaccttctccatgggcctcctctgcctcaccctcttcgtcgaggagtgcctccgccgccgcgtcacccgcaagcacatgatcctcgtcgtcgtcaccaccctctgcgccatcatcctcggcggcctcacctggatggacctcctccgcgccctcatcatgctcggcaacaccatgtcctcccgcatgggcggccagatccacctcgccatcatggccgtcttcaagatgtcccccggctacgtcctcggcatcttcctccgcaagctcacctcccgcgagaccgccctcatggtcatcggcatggccatgaccaccgtcctctccatcccccacgacctcatggagttcgtcgacggcatctccctcggcctcatcctcctcaagatggtcacccacttcgacaacacccaggtcggcaccctcgccctctccctcaccttcatcaagtccaccatgcccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctccaagcgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaccgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccgtcaccatgaccctctggtacatgtggcaggtcaagacccagcgctccggcgccctctgggacgtcccctcccccgccgccgcccagaaggccaccctcaccgagggcgtctaccgcatcatgcagcgcggcctcttcggcaagacccaggtcggcgtcggcatccacatggagggcgtcttccacaccatgtggcacgtcacccgcggctccgtcatctgccacgagtccggccgcctcgagccctcctgggccgacgtccgcaacgacatgatctcctacggcggcggctggcgcctcggcgacaagtgggacaaggaggaggacgtccaggtcctcgccgtcgagcccggcaagaaccccaagcacgtccagaccaagcccggcctcttcaagaccctcaccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcaccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcgtccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcatcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctccgcaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgccccaagtggctcgacgcccgcgtctacgccgaccccgtcgccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggcaaggcctaccagcacgccctcaacgagctccccgagtccctcgagaccctcatgctcatcgccctcctcggcgccatgaccgccggcatcttcctcttcttcatgcagggcaagggcatgggcaagctctccatgggcctcatcgccatcgccgtcgcctccggcctcctctgggtcgccgagatccagccccagtggatcgccgcctccatcatcctcgagttcttcctcatggccctcctcatccccgagcccgagaagcagcgcaccccccaggacaaccagctcatctacgtcatcctcaccatcctcaccatcatcggcctcgtcgccgccaacgagatgggcctcatcgagaagaccaagaccgacttcggcttctaccaggagaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgccttctccctcatcaagaacacccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagtacgccgtctcccgcggcacctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgcaagcacggcggctccctcgtccgctgccccctctcccgcaactccacccacgagatgtactgggtctccggcgtctcccgcaacatcgtctcctccgtcaacaccacctccaagatgctcctcaaccgcttcaccacccgctaccgcaagcccacctacgagaaggacgccgacctcggcgccggcacccgctccgtctccaccgagaccgagaagcccgacatggccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcgtccccatggtcacccagctcgccatgaccgacaccacccccttcggccagcagcgcgtcttcaaggagaaggtcgacacccgcaccccccagcccaagcccggcacccgcatgatcatgaccaccaccgccaactggctctgggccctcctcggcaagaagaagaacccccgcctctgcacccgcgaggagttcatctccaaggtccgctccaacgccgccatcggcgccgtctcccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggacatcgacaagaaggacggcgacctcatctacgccgacgacaccgccggctgggacacccgcatcaccgaggacgacctcctcaacgaggagctcatcaccgagcagatggccccccaccacaagatcctcgccaaggccatcttcaagctcacctaccagaacaaggtcgtcaaggtcctccgccccacccccaagggcgccgtcatggacatcatctcccgcaaggaccagcgcggctccggccaggtcggcacctacggcctcaacaccttcaccaacatggaggtccagctcatccgccagatggaggccgagggcgtcatcacccgcgacgacatgcacaaccccaagggcctcaaggagcgcgtcgagaagtggctcaaggagtgcggcgtcgaccgcctcaagcgcatggccatctccggcgacgactgcgtcgtcaagcccctcgacgagcgcttctccacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgaccgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcatcgaggagtacgtcgactacatgcccgtcatgaagcgctactccgcccccttcgagtccgagggcgtcctctga

SEQ ID NO: 13065 - RNA, 9867 nt, synthetic construct
  misc_feature 1..9867: note = derived and/or modified CDS sequence (opt2) from DENV-4__JQ922558__SS-prME
  source 1..9867: mol_type = other RNA
tccaccctcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcatcaagaccaccgccaaggaggtcgccctcctccgcacctactgcatcgaggcctccatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttcctctgcctcggcaagatcaccggcaacctcgtccagatcgagaacctcgagtacaccgtcgtcgtcaccgtccacaacggcgacacccacgccgtcggcaacgacatctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtgggtcctcgacctccccctcccctgggccgccggcgccgacacctccaaggtccagtggaactacaaggagcgcatggtcaccttcaaggtcccccacgccaagcgccaggacgtcaccgtcctcggctcccaggagggcgccatgcactccgccctcaccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcatcatctcctccacccccttcgccgagcacaccaactccgtcaccaacatcgagctcgagccccccttcggcgactcctacatcgtcatcggcgtcggcgactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatggtccgcatcctcatcggcctcctcgtcctctggatcggcaccaactcccgcaacacctccatggccatgacctgcatcgccatcggcggcatcaccctcttcctcggcttcaccgtccacgccgacatgggctgcgccgtctcctggtccggcaaggagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgtcaacgacctcaagtactcctggaagacctggggcaaggccaagatcttcacccccgaggcccgcaactccaccttcctcatcgacggccccgacacctccgagtgccccaacgagcgccgcgcctggaacttcctcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagccctggcagatcggcaacgcctccctcatcgaggtcaagacctgcctctggcccaagacccacaccctctggtccaacggcgtcctcgagtcccagatgctcatccccaaggcctacgccggccccttctcccagcacaactaccgccagggctacgccacccagaccatcggcccctggcacctcggcaagctcgagatcgacttcggcgagtgccccggcaccaccgtcaccatccaggaggactgcaaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtctccgccggccagggcacctccgagaccttctccatgggcctcctctgcctcaccctcttcgtcgaggagtgcctccgccgccgcgtcacccgcaagcacatgatcctcgtcgtcgtcaccaccctctgcgccatcatcctcggcggcctcacctggatggacctcctccgcgccctcatcatgctcggcgacaccatgtccggccgcatgggcggccagatccacctcaccatcatggccgtcttcaagatgtcccccggctacgtcctcggcgtcttcctccgcaagctcacctcccgcgagaccgccctcatcgtcatcggcatggccatgaccaccgtcctctccatcccccacgacctcatggagttcatcgacggcatctccctcggcctcatcctcctcaagatggtcgcccacttcgacaacacccaggtcggcaccctcgccctctccctcaccttcatccgctccaccatgcccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctccaagcgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccactgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccgtcaccatgaccctctggtacatgtggcaggtcaagacccagcgctccggcgccctctgggacgtcccctcccccgccgccgcccagaaggccaccctcaccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaacaagaagggcaaggtcatcggcctctacggcaacggcgtcgtcaccaagtccggcgactacgtctccgccatcacccaggccgagcgcatcggcgaccccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccgccaaccccctctcctccacccgcgtccccaactacaacctcatcgtcatggacgaggcccacctccaggacctctccatcgtcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgcccgccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagatccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgccccaagtggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatggccatcgccgtcgcctccggcctcctctgggtcgccgagatccagccccagtggatcgccgcctccatcatcctcgagttcttctccatggccctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctctccgtccactacgccatcatcggccccggcctccaggccaaggccacccgcgaggcccagaagcgctccgccgccggcatcatgaagaaccccaccgtcgacggcatcaccgtcatcgacctcgagcccatctcctacgaccccaagttcgagaagcagctcggccaggtcatgctcctcgccctctgcgccggccagctcctcctcatgcgcaccacctgggccttctgcgaggtcctcaccctcgccaccggccccatcctcaccctctgggagggcaaccccggccgcttctggaacaccaccatccccgtctccaccgccaacatcttccgcggctcctacctcgccggcgccggcctcgccttctccctcatcaagaacgcccagaccccccgccgcggcaccggcaccaccggcgagaccctcggcgagaagtggaagcgccagctcaactccctcgaccgcaaggagttcgaggagtacaagcgctccggcatcttcgaggtcgaccgccacgagatcaagtacaccctcaaggacggctccaagatcaaccacgccatgtccaccggctccatcaagatccgcggcatcgacgagcgcggcatggtcaagcccaagggcaaggtcgtcgaccagggctgcggccgcggcggctggtcccactacaccgccaccgccaagaaggtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgcaagcacggcggctccctcgtccgctgccccctctcccgcaactccacccacgagatgtactgggtctccggcgtctccggcaacatcgtctcctccgtcaacaccacctccaagatgctcctcaaccgcttcaccacccgccaccgcaagcccacctacgagaaggacgtcgacctcggcgccggcacccgctccgtctccatcgagaccgagaagcccgacatgaccatcatcggccgccgcctccagcgcctccgcgaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgagttcaaggagaaggtctacacctccaccccccaccccaagccctggacccgcatggtcatgaccaccaccgccaactggctctgggccctcggcggcaagaagaagtccccccgcctctgcacctgggaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggacatcgacaagaaggacggcgacctcatctacgccgacgacaccgccggctgggacacccgcatcaccgaggacgacctcctcaacgaggagctcatcaccgagcagatggccccccaccaccgcatcctcgccaaggccatcttcaagctcacctaccactccaaggtcatgaaggtcctccgccccacccccaagggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctcaaggagtgcggcgtcgaccgcctcaagcgcatggccatctccggcgacgactgcgtcgtcaagcccctcgacgagcgcttctccacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgaccgacaagacccccgtccactcctgggaggacgtcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgtcatgaagcgctactccgcccccatcgagtccgagggcgtcctctga

SEQ ID NO: 13066 - RNA, 9867 nt, synthetic construct
  misc_feature 1..9867: note = derived and/or modified CDS sequence (opt2) from DENV-4__JQ922559__SS-prME
  source 1..9867: mol_type = other RNA
tccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccgcctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcatcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcatcaagaccaccgccaaggaggtcgccctcctccgcacctactgcatcgaggcctccatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttcctctgctccggcaagatcaccggcaacctcgtccagatcgagaacctcgagtacaccgtcgtcgtcaccgtccacaacggcgacacccacgccgtcggcaacgacatctccatccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccgccggcgccgacacctccgaggtccagtggaactacaaggagcgcatggtcaccttcaaggtcccccacgccaagcgccaggacgtcaccgtcctcggctcccaggagggcgccatgcactccgccctcaccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcatcatctcctccacccccttcgccgagaacacctactccgtcaccaacatcgagctcgagccccccttcggcgactcctacatcatcatcggcgtcggcgactccgccctcaccctccactggttccgcaagggctcctccatcggcaagatgttcgagtccacctaccgcggcgccaagcgcatggccatcctcggcgagaccgcctgggacttcggctccgtcggcggcctcctcacctccctcggcaaggccgtccaccaggtcttcggctccgtctacaccaccatgttcggcggcgtctcctggatggtccgcatcctcatcggcctcctcgtcctctggatcggcaccaactcccgcaacacctccatggccatgtcctgcatcgccgtcggcggcatcaccctcttcctcggcttcaccgtccacgccgacatgggctgcgccgtctcctggtccggcaaggagctcaagtgcggctccggcatcttcgtcatcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccatcgtcgccggcgacgtcaagggcgtcctctccaagggcaagcgcgccctcgccccccccgtcaacgacctcaagtactcctggaagacctggggcaaggccaagatcttcacccccgagacccgcaactccaccttcctcatcgacggccccgacacctccgagtgccccaacgagcgccgcgcctggaacttcctcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagaaggcctccctcatcgaggtcaagacctgcctctggcccaagacccacaccctctggtccaacggcgtcctcgagtcccagatgctcatccccaaggcctacgccggccccttctcccagcacaactaccgccagggctacgccacccagaccgtcggcccctggcacctcggcaagctcgagatcgacttcggcgagtgccccggcaccaccgtcaccatccaggaggactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagcgcgaggagaacatggtcaagtcccaggtctccgccggccagggcacctccgagaccttctccatgggcctcctctgcctcaccctcttcgtcgaggagtgcctccgccgccgcgtcacccgcaagcacatgatcctcgtcgtcgtcaccaccctctgcgccatcatcctcggcggcctcacctggatggacctcctccgcgccctcatcatgctcggcgacaccatgtcctcccgcatgggcggccagatccacctcgccatcatggccgtcttcaagatgtcccccggctacgtcctcggcatcttcctccgcaagctcacctcccgcgagaccgccctcatggtcatcggcatggccatgaccaccgtcctctccatcccccacgacctcatggagttcatcgacggcatctccctcggcctcatcctcctcaagatggtcacccacttcgacaacacccagatgggcaccctcgccctctccctcaccttcatcaagtccaccatgcccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctccaagcgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccgtcaccatgaccctctggtacatgtggcaggtcaagacccagcgctccggcgccctctgggacgtcccctcccccgccgccgcccagaaggccaccctcaccgagggcgtctaccgcatcatgcagcgcggcctcttcggcaagacccaggtcggcgtcggcatccacatggagggcgtcttccacaccatgtggcacgtcacccgcggctccgtcatctgccacgagtccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcctctccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcaccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgtcatgggcgccaacttccgcgccggccgcgtcatcgacccccgccgctgcctcaagcccgtcatcatcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctccgcaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgccccaagtggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggcaaggcctaccagcacgccctcaacgagctccccgagtccctcgagaccctcatgctcgtcgccctcctcggcgccatgaccgccggcatcttcctcttcttcatgcagggcaagggcatcggcgagctctccatgggcctcatcgccatcgccggcgcctccggcctcctctggggcaccaagaccccccccccctggggcgccgcctccaacatcctcgagttcttcctcatggtcctcctcatccccgagcccgagaagcagcgcaccccccaggacaaccagctcatctacgtcatcctcaccatcctcaccatcatcggcctcgtcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcatcgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcgtcaccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagcaggccgtctcccgcggcacctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactcccgcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgcaagcacggcggctccctcgtccgctgccccctctcccgcaactccacccacgagatgtactgggtctccggcgtctccggcaacatcgtctcctccgtcaacaccacctccaagatgctcctcaaccgcttcaccaccaagcaccgcaagcccacctacgagaaggacgccgacctcggcgccggcacccgctccgtctccaccgagaccgagaagcccgacatgaccatcatcggccgccgcctccagcgcctccaggaggagcaccaggagacctggcactacgaccaggagaacccctaccgcacctgggcctaccacggcggctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatggtcatgaccaccaccgccaactggctctgggccctcctcggcaagaagaagaacccccgcctctgcacccgcgaggagttcatctccaaggtccgctccaacgccgccatcggcgccgtctcccaggaggagcagggctggacctcctccttcgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggacctcgacaagcgcgaccgctccctcgtcttcgccgacgacaccgccggctgggacaccaagatccccgaggacgacctcctcaaggagaagcccatccccggccccatggccccccaccagcgcatccccgcccgcgccatcttcaagctcacctaccagaacaaggtcgtcaaggtcctccgcctcaagctcaagggcgccgtcatggacatcatctcccgcaaggagcagcgcggctccggccaggtcggcacctacggcctcaacaccttcaccaacatggaggtccagctcatccgccagatggaggccgagggcgtcatcacccgcgacgacatgcacaaccccaagggcctcaaggagcgcgtcgagaagtggctcaaggagtgcggcgtcgaccgcctcgagcgcatggccatctccggcgacgactgcgtcgtcaagcccctcgacgagcgcttctccacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgaccgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcatcgagggctacgtcgactacttcctcctcatcaagtggtactccgcccccttcgagtccgagggcgtcctctga

SEQ ID NO: 13067 - RNA, 9867 nt, synthetic construct
  misc_feature 1..9867: note = derived and/or modified CDS sequence (opt2) from DENV-4__KF955510__SS-prME
  source 1..9867: mol_type = other RNA
tccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccgcctgggtcatgtacggcacctgcacccagtccggcgagcgccgccgcgagaagcgctccgtcgccctcaccccccactccggcatgggcctcgagacccgcaccgagacctggatgtcctccgagggcgcctggaagcacgcccagcgcgtcgagtcctggatcctccgcaagcccggcttcgccctctccgccggcttcatggcctacatgatcggccagaccggcatccagcgcaccgtcttcttcatcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcatcaagaccaccgccaaggaggtcgccctcctccgcacctactgcatcgaggcctccatctccaacatcaccaccgccacccgctgccccacccagggcgagccctacctcaaggaggagcaggaccagcagtacatctgccgccgcgacatggtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgagaccgccaccatcaccccccgctccccctccgtcgaggtccgcctccccgactacggcgagctcaccctcgactgcgagccccgctccggcatcgacttcaacgagatgatcctcatgaagatgaagaccaagacctggctcgtccacaagcagtggttcctcgacctccccctcccctggaccgccggcgccgacacctccgaggtccactggaaccacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcaccggcgccccctgcaaggtccccatcgagatccgcgacgtcaacaaggagaaggtcgtcggccgcatcatctcctccacccccttcgccgagaacaccaactccgtcaccaacatcgagctcgagccccccttcggcgactcctacatcgtcatcggcgccggcgactccgccctcaccctccactggttccgcaagggctcctccatcggcaagatgttcgagtccacctaccgcggcgccaagcgcatggccatcctcggcgagaccgcctgggacttcggctccgtcggcggcctcctcacctccctcggcaaggccgtccaccaggtcttcggctccgtctacaccaccatgttcggcggcgtctcctggatggtccgcatcctcatcggcctcctcgtcctctggatcggcaccaactcccgcaacacctccatggccatgtcctgcatcgtcgtcggcggcatcaccctcttcctcggcttcaccgtccacgccgacatgggctgcgtcgtctcctggtccggcaaggagctcaagtgcggctccggcatcttcgtcatcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctctccaagggcaagcgcgccctcgccccccccgtcaacgacctcaagtactcctggaagacctggggcaaggccaagatcttcacccccgagacccgcaactccaccttcctcgtcgacggccccgacacctccgagtgccccaacgagcgccgcgcctggaacttcctcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagaaggcctccctcatcgaggtcaagacctgcctctggcccaagacccacaccctctggtccaacggcgtcctcgagtcccagatgctcatccccaaggcctacgccggccccatctcccagcacaactaccgccagggctacgccacccagaccgtcggcccctggcacctcggcaagctcgagatcgacttcggcgagtgccccggcaccaccgtcaccatccaggaggactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctcaacgagaaggaggagaacatggtcaagtcccaggtctccgccggccagggcacctccgagaccttctccatgggcctcctctgcctcaccctcttcgtcgaggagtgcctccgccgccgcgtcacccgcaagcacatgatcctcgtcgtcgtcaccaccctctgcgccatcatcctcggcggcctcacctggatggacctcctccgcgccctcatcatgctcggcgacaccatgtccggccgcatgggcggccagatccacctcgccatcatggccatgttcaagatgtcccccggctacgtcctcggcatcttcctccgcaagctcacctcccgcgagaccgccctcatggtcatcggcatggccatgaccaccgtcctctccatcccccacgacctcatggagttcatcgacggcatctccctcggcctcatcctcctcaagatggtcacccacttcgacaacacccaggtcggcaccctcgccctctccctcaccttcatcaagtccaccatgcccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctccaagcgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccgtcaccatgaccctctggtacatgtggcaggtcaagacccagcgctccggcgccctctgggacgtcccctcccccgccgccgcccagaaggccaccctcaccgagggcgcctaccgcatcatgcagcgcggcctcttcggcaagacccaggtcggcgtcggcatccacatggagggcgtcttccacaccatgtggcacgtcacccgcggctccgtcatctgccacgagtccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcaccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctccgcaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgccccaagtggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggcaaggcctaccagcacgccctcaacgagctccccgagtccctcgagaccctcatgctcgtcgccctcctcggcgccatgaccgccggcatcttcctcttcttcatgcagggcaagggcatgggcaagctctccatgggcctcatcgccatcgccgtcgcctccggcctcctctgggtcgccgagatccagccccagtggatcgccgcctccatcatcctcgagttcttcctcatggtcctcctcgtccccgagcccgagaagcagcgcaccccccaggacaaccagctcatctacgtcatcctcaccatcctcaccatcatcgccctcgtcgccgccaacgagatgggcctcatcgagaagaccaagaccgacttcggcttctaccaggccaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccaccggcgagaccctcggcgagaagtggaagcgccagctcaactccctcgaccgcaagggcttcgaggagtacaagcgctccggcatcctcgaggtcgaccgcaccgaggccaagtccgccctcaaggacggctccaagatcaagtacgccgtctcccgcggcacctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgcaagcacggcggctccctcgtccgctgccccctctcccgcaactccacccacgagatgtactgggtctccggcgtctccggcaacatcgtctcctccgtcaacaccacctccaagatgctcctcaaccgcttcaccacccgccaccgcaagcccacctacgagaaggacgccgacctcggcgccggcacccgctccgtctccaccgagaccgagaagcccgacatgaccatcatcggccgccgcctccagcgcctccaggaggagcacaaggagacctggcactacgaccacgagaacccctaccgcacctgggcctaccacggctcctacgaggccccctccaccggctccgcctcctccatggtcaacggcgtcgtcaagctcctcaccaagccctgggacgtcgtccccatggtcacccagctcgccatgaccgacaccacccccttcggccagcagcgcgtcttcaaggagaaggtcgacacccgcaccccccagcccaagcccggcacccgcgtcgtcatgaccaccaccgccaactggctctgggccctcctcggccgcaagaagaacccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggacatcgacaagaaggacggcgacctcatctacgccgacgacaccgccggctgggacacccgcatcaccgaggacgacctcctcaacgaggagctcatcaccgagcagatggccccccaccacaagatcctcgccaaggccatcttcaagctcacctaccagaacaaggtcgtcaaggtcctccgccccacccccaagggcgccgtcatggacatcatctcccgcaaggaccagcgcggctccggccaggtcggcacctacggcctcaacaccttcaccaacatggaggtccagctcatccgccagatggaggccgagggcgtcatcacccgcgacgacatgcacaaccccaagggcctcaaggagcgcgtcgagaagtggctcaaggagtgcggcgtcgaccgcctcaagcgcatggccatctccggcgacgactgcgtcgtcaagcccctcgacgagcgcttctccacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgatcgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgtcatgaagcgctactccgcccacttcgagtccgagggcgtcctctga

SEQ ID NO: 13068 - RNA, 9867 nt, synthetic construct
  misc_feature 1..9867: note = derived and/or modified CDS sequence (opt2) from DENV-4__GQ868594__SS-prME
  source 1..9867: mol_type = other RNA
tccaccatgaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacgagtgccccctcctcgtcaacaccgagcccgaggacatcgactgctggtgcaacctcacctccgcctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcatcaagaccaccgccaaggaggtcgccctcctccgcacctactgcatcgaggcctccatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacatccccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctgggccgccggcgccgacacctccgaggtccactggaactacaaggagcgcatggtcaccttcaaggtcccccacgccaagcgccaggacgtcatcgtcctcggctcccaggagggcgccatgcactccgccctcaccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcatcatctcctccacccccttcgccgagtacaccaactccgtcaccaacatcgagctcgagccccccttcggcgactcctacatcgtcatcggcgtcggcgactccgccctcaccctccactggttccgcaagggctcctccatcggcaagatgctcgagtccacctaccgcggcgccaagcgcatggccatcctcggcgagaccgcctgggacttcggctccgtcggcggcctcctcacctccctcggcaaggccgtccaccaggtcttcggctccgtctacaccaccatgttcggcggcgtctcctggatggtccgcatcctcatcggcttcctcgtcctctggatcggcaccaactcccgcaacacctccatggccatgacctgcatcgccgtcggcggcatcaccctcttcctcggcttcaccgtccacgccgacaccggctgcgccgtctcctggtccggcaaggagctcaagtgcggctccggcatcttcgtcatcgacaacgtccacacctggaccgagcagtacaagttccagcccgagtcccccgcccgcctcgcctccgccatcctcaacgcccacaaggacggcgtctgcggcatccgctccaccacccgcctcgagaacatcatgtggaagcagatcaccaacgagctcaactacgtcctctgggagggcggccacgacctcaccgtcgtcgccggcgacgtcaagggcgtcctctccaagggcaagcgcgccctcgccccccccgtcaacgacctcaagtactcctggaagacctggggcaaggccaagatcttcacccccgaggccaagaactccaccttcctcatcgacggccccgacacctccgagtgccccaacgagcgccgcgcctggaacttcctcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagaaggcctccctcatcgaggtcaagacctgcctctggcccaagacccacaccctctggtccaacggcgtcctcgagtcccagatgctcatccccaaggcctacgccggccccttctcccagcacaactaccgccagggctacgccacccagaccgtcggcccctggcacctcggcaagctcgagatcgacttcggcgagtgccccggcaccaccgtcaccatccaggaggactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtctccgccggccagggcacctccgagaccttctccatgggcctcctctgcctcaccctcttcgtcgaggagtgcctccgccgccgcgtcacccgcaagcacatgatcctcgtcgtcgtcaccaccctctgcgccatcatcctcggcggcctcacctggatggacctcctccgcgccctcatcatgctcggcgacaccatgtccggccgcatgggcggccagatccacctcgccatcatggccgtcttcaagatgtcccccggctacgtcctcggcatcttcctccgcaagctcacctcccgcgagaccgccctcatggtcatcggcatggccatgaccaccgtcctctccatcccccacgacctcatggagttcatcgacggcatctccctcggcctcatcctcctcaagatggtcacccacttcgacaacacccaggtcggcaccctcgccctctccctcaccttcatccgctccaccatgcccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctccaagcgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacatcgaggagaccaacatgatcaccctcctcgtcaagctcgccctcatcaccgtctccggcctctaccccctcgccatccccgtcaccatgaccctctggtacatgtggcaggtcaagacccagcgctccggcgccctctgggacgtcccctcccccgccgccgcccagaaggccaccctcaccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcaccggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatctccaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagaaccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgccccaagtggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggcaaggcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcgccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcatcgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccttctgcgaggtcctcaccctcgccaccggccccgtcctcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagcacgccgtctcccgcggctcctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgcaagcacggcggctccctcgtccgctgccccctctcccgcaactccacccacgagatgtactgggtctccggcgtctccggcaacatcgtctcctccgtcaacaccacctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatggtcatgaccaccaccgccaactggctctgggccctcctcggcaagaagaagaacccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggacatcgacaagaaggacggcgacctcatctacgccgacgacaccgccggctgggacacccgcatcaccgaggacgacctcctcaacgaggagctcatcaccgagcagatggccccccaccacaagatcctcgccaaggccatcttcaagctcacctaccagaacaaggtcgtcaaggtcctccgccccacccccaagggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcacaaccccaagggcctcaaggagcgcgtcgagaagtggctcaaggagtgcggcgtcgaccgcctcaagcgcatggccatctccggcgacgactgcgtcgtcaagcccctcgacgagcgcttctccacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgaccgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgtcatgaagcgctactccgcccccttcgagtccgagggcgtcctctga

SEQ ID NO: 13069 - RNA, 9867 nt, synthetic construct
  misc_feature 1..9867: note = derived and/or modified CDS sequence (opt2) from DENV-4__FJ024424__SS-prME
  source 1..9867: mol_type = other RNA
tccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggcctccatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccaccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccgccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctcctccacccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggtccggcaaggagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgtctccgacctcaagtactcctggaagacctggggcaaggccaagatcttcacccccgaggcccgcaactccaccttcctcatcgacggccccgacacctccgagtgccccaacgagcgccgcgcctggaactccctcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagaaggcctccctcatcgaggtcaagacctgcctctggcccaagacccacaccctctggtccaacggcgtcctcgagtcccagatgctcatccccaagtcctacgccggccccttctcccagcacaactaccgccagggctacgccacccagaccgtcggcccctggcacctcggcaagctcgagatcgacttcggcgagtgccccggcaccaccgtcaccatccaggaggactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcgccgccggccagggcacctccgagaccttctccatgggcctcctctgcctcaccctcttcgtcgaggagtgcctccgccgccgcgtcacccgcaagcacatgatcctcgccgtcgtcatcaccctctgcgccatcatcctcggcggcctcacctggatggacctcctccgcgccctcatcatgctcggcgacaccatgtccggccgcatcggcggccagacccacctcgccatcatggccgtcttcaagatgtcccccggctacgtcctcggcgtcttcctccgcaagctcacctcccgcgagaccgccctcatggtcatcggcatggccatgaccaccaccctctccatcccccacgacctcatggagctcatcgacggcatctccctcggcctcatcctcctcaagatcgtcacccagttcgacaacacccaggtcggcaccctcgccctctccctcaccttcatccgctccaccatgtccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccgtcaccatgaccctctggtacatgtggcaggtcaagacccagcgctccggcgccctctgggacgtcccctcccccgccgccacccagaaggccgccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccacccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgcccccgctggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcaccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagcacgccgtctcccgcggctcctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgcaagcacggcggcaacctcgtccgctgccccctctcccgcaactccacccacgagatgtactgggtctccggcgcctccggcaacatcgtctcctccgtcaacaccacctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacatgatccccatggtcacccagctcgccatgaccgacaccacccccttcggccagcagcgcgtcttcaaggagaaggtcgacacccgcaccccccagcccaagcccggcacccgcatggtcatgaccaccaccgccaactggctctgggccctcctcggcaagaagaagaacccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggagatcgacaagaaggacggcgacctcatgtacgccgacgacaccgccggctgggacacccgcatcaccgaggacgacctccagaacgaggagctcatcaccgagcagatggccccccaccacaagatcctcgccaaggccatcttcaagctcacctaccagaacaaggtcgtcaaggtcctccgccccaccccccgcggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctccgcgagtgcggcgtcgaccgcctcaagcgcatggccatctccggcgacgactgcgtcgtcaagcccctcgacgagcgcttcggcacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgatcgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgtcatgaagcgctactccgccccctccgagtccgagggcgtcctctga

SEQ ID NO: 13070 - RNA, 9867 nt, synthetic construct
  misc_feature 1..9867: note = derived and/or modified CDS sequence (opt2) from DENV-4__EU854295__SS-prME
  source 1..9867: mol_type = other RNA
tccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggcctccatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccgccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctcctccacccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggtccggccgcgagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgtctccgacctcaagtactcctggaagacctggggcaaggccaagatcttcacccccgaggcccgcaactccaccttcctcatcgacggccccgacacctccgagtgccccaacgagcgccgcgcctggaactccctcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagaaggcctccctcatcgaggtcaagacctgcctctggcccaagacccacaccctctggtccaacggcgtcctcgagtcccagatgctcatccccaagtcctacgccggccccttctcccagcacaactaccgccagggctacgccacccagaccgtcggcccctggcacctcggcaagctcgagatcgacttcggcgagtgccccggcaccaccgtcaccatccaggaggactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcgccgccggccccggcacctccgagaccttctccatgggcctcctctgcctcaccctcttcgtcgaggagtgcctccgccgccgcgtcacccgcaagcacatgatcctcgccgtcgtcatcaccctctgcgccatcatcctcggcggcctcacctggatggacctcctccgcgccctcatcatgctcggcgacaccatgtccggccgcatcggcggccagacccacctcgccatcatggccgtcttcaagatgtcccccggctacgtcctcggcgtcttcctccgcaagctcacctcccgcgagaccgccctcatggtcatcggcatggccatgaccaccaccctctccatcccccacgacctcatggagctcatcgacggcatctccctcggcctcatcctcctcaagatcgtcacccagttcgacaacacccaggtcggcaccctcgccctctccctcaccttcatccgctccaccatgtccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccgtcaccatgaccctctggtacatgtggcaggtcaagacccagcgctccggcgccctctgggacgtcccctcccccgccgccacccagaaggccgccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgcccccgctggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcaccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagcacgccgtctcccgcggctcctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgcaagcacggcggcaacctcgtccgctgccccctctcccgcaactccacccacgagatgtactgggtctccggcgcctccggcaacatcgtctcctccgtcaacaccacctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcgtcgtcatgaccaccaccgccaactggctctgggccctcctcggcaagaagaagaacccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggagatcgacaagaaggacggcgacctcatgtacgccgacgacaccgccggctgggacacccgcatcaccgaggacgacctccagaacgaggagctcatcaccgagcagatggccccccaccacaagatcctcgccaaggccatcttcaagctcacctaccagaacaaggtcgtcaaggtcctccgccccaccccccgcggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctccgcgagtgcggcgtcgaccgcctcaagcgcatggccatctccggcgacgactgcgtcgtcaagcccctcgacgagcgcttcggcacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgatcgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgtcatgaagcgctactccgccccctccgagtccgagggcgtcctctga

SEQ ID NO: 13071 - RNA, 9867 nt, synthetic construct
  misc_feature 1..9867: note = derived and/or modified CDS sequence (opt2) from DENV-4__EU854296__SS-prME
  source 1..9867: mol_type = other RNA
tccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggcctccatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccgccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctcctccacccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggtccggccgcgagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgccaagggcgtcctcaccaagggcaagcgcgccctcaccccccccgtctccgacctcaagtactcctggaagacctggggcaaggccaagatcttcacccccgaggcccgcaactccaccttcctcatcgacggccccgacacctccgagtgccccaacgagcgccgcgcctggaactccctcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagaaggcctccctcatcgaggtcaagacctgcctctggcccaagacccacaccctctggtccaacggcgtcctcgagtcccagatgctcatccccaagtcctacgccggccccttctcccagcacaactaccgccagggctacgccacccagaccgtcggcccctggcacctcggcaagctcgagatcgacttcggcgagtgccccggcaccaccgtcaccatccaggaggactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcaccgccggccagggcacctccgagaccttctccatgggcctcctctgcctcaccctcttcgtcgaggagtgcctccgccgccgcgtcacccgcaagcacatgatcctcgccgtcgtcatcaccctctgcgccatcatcctcggcggcctcacctggatggacctcctccgcgccctcatcatgctcggcgacaccatgtccggccgcatcggcggccagacccacctcgccatcatggccgtcttcaagatgtcccccggctacgtcctcggcgtcttcctccgcaagctcacctcccgcgagaccgccctcatggtcatcggcatggccatgaccaccaccctctccatcccccacgacctcatggagctcatcgacggcatctccctcggcctcatcctcctcaagatcgtcacccagttcgacaacacccaggtcggcaccctcgccctctccctcaccttcatccgctccaccatgtccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccgtcaccatgaccctctggtacatgtggcaggtcaagacccagcgctccggcgccctctgggacgtcccctcccccgccgccacccagaaggccgccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgcccccgctggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcaccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggccaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccatcggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagcacgccgtctcccgcggctcctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctaccgccccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgcaagcacggcggcaacctcgtccgctgccccctctcccgcaactccacccacgagatgtactgggtctccggcgcctccggcaacatcgtctcctccgtcaacaccacctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatggtcatgaccaccaccgccaactggctctgggccctcctcggcaagaagaagaacccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggagatcgacaagaaggacggcgacctcatgtacgccgacgacaccgccggctgggacacccgcatcaccgaggacgacctccagaacgaggagctcatcaccgagcagatggccccccaccacaagatcctcgccaaggccatcttcaagctcacctaccagaacaaggtcgtcaaggtcctccgccccaccccccgcggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctccgcgagtgcggcgtcgaccgcctcaagcgcatggccatctccggcgacgactgcgtcgtcaagcccctcgacgagcgcttcggcacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgatcgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgtcatgaagcgctactccgccccctccgagtccgagggcgtcctctga

SEQ ID NO: 13072 - RNA, 9867 nt, synthetic construct
  misc_feature 1..9867: note = derived and/or modified CDS sequence (opt2) from DENV-4__GQ199878__SS-prME
  source 1..9867: mol_type = other RNA
tccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggcctccatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccgccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctcctccacccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggtccggccgcgagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgtctccgacctcaagtactcctggaagacctggggcaaggccaagatcttcacccccgaggcccgcaactccaccttcctcatcgacggccccgacacctccgagtgccccaacgagcgccgcgcctggaactccctcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagaaggcctccctcatcgaggtcaagacctgcctctggcccaagacccacaccctctggtccaacggcgtcctcgagtcccagatgctcatccccaagtcctacgccggccccttctcccagcacaactaccgccagggctacgccacccagaccgtcggcccctggcacctcggcaagctcgagatcgacttcggcgagtgccccggcaccaccgtcaccatccaggaggactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcgccgccggccagggcacctccgagaccttctccatgggcctcctctgcctcaccctcttcgtcgaggagtgcctccgccgccgcgtcacccgcaagcacatgatcctcgccgtcgtcatcaccctctgcgccatcatcctcggcggcctcacctggatggacctcctccgcgccctcatcatgctcggcgacaccatgtccggccgcatcggcggccagacccacctcgccatcatggccgtcttcaagatgtcccccggctacgtcctcggcgtcttcctccgcaagctcacctcccgcgagaccgccctcatggtcatcggcatggccatgaccaccaccctctccatcccccacgacctcatggagctcatcgacggcatctccctcggcctcatcctcctcaagatcgtcacccagttcgacaacacccaggtcggcaccctcgccctctccctcaccttcatccgctccaccatgtccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccgtcaccatgaccctctggtacatgtggcaggtcaagacccagcgctccggcgccctctgggacgtcccctcccccgccgccacccagaaggccgccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgcccccgctggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcaccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagcacgccgtctcccgcggctcctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgcaagcacggcggcaacctcgtccgctgccccctctcccgcaactccacccacgagatgtactgggtctccggcgcctccggcaacatcgtctcctccgtcaacaccacctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatggtcatgaccaccaccgccaactggctctgggccctcctcggcaagaagaagaacccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggagatcgacaagaaggacggcgacctcatgtacgccgacgacaccgccggctgggacacccgcatcaccgaggacgacctccagaacgaggagctcatcaccgagcagatggccccccaccacaagatcctcgccaaggccatcttcaagctcacctaccagaacaaggtcgtcaaggtcctccgccccaccccccgcggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctccgcgagtgcggcgtcgaccgcctcaagcgcatggccatctccggcgacgactgcgtcgtcaagcccctcgacgagcgcttcggcacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgatcgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgtcatgaagcgctactccgccccctccgagtccgagggcgtcctctga

SEQ ID NO: 13073 - RNA, 9867 nt, synthetic construct
  misc_feature 1..9867: note = derived and/or modified CDS sequence (opt2) from DENV-4__GQ199879__SS-prME
  source 1..9867: mol_type = other RNA
tccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggcctccatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccgccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctcctccacccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatggtccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggtccggccgcgagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgtctccgacctcaagtactcctggaagacctggggcaaggccaagatcttcacccccgaggcccgcaactccaccttcctcatcgacggccccgacacctccgagtgccccaacgagcgccgcgcctggaactccctcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagaaggcctccctcatcgaggtcaagacctgcctctggcccaagacccacaccctctggtccaacggcgtcctcgagtcccagatgctcatccccaagtcctacgccggccccttctcccagcacaactaccgccagggctacgccacccagaccgtcggcccctggcacctcggcaagctcgagatcgacttcggcgagtgccccggcaccaccgtcaccatccaggaggactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctcaacgagaaggaggagaacatggtcaagtcccaggtcaccgccggccagggcacctccgagaccttctccatgggcctcctctgcctcaccctcttcgtcgaggagtgcctccgccgccgcgtcacccgcaagcacatgatcctcgtcgtcgtcatcaccctctgcgccatcatcctcggcggcctcacctggatggacctcctccgcgccctcatcatgctcggcgacaccatgtccggccgcatcggcggccagatccacctcgccatcatggccgtcttcaagatgtcccccggctacgtcctcggcgtcttcctccgcaagctcacctcccgcgagaccgccctcatggtcatcggcatggccatgaccaccgtcctctccatcccccacgacctcatggagctcatcgacggcatctccctcggcctcatcctcctcaagatcgtcacccagttcgacaacacccaggtcggcaccctcgccctctccctcaccttcatccgctccaccatgcccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccgtcaccatgaccctctggtacatgtggcaggtcaagacccagcgctccggcgccctctgggacgtcccctcccccgccgccacccagaaggccgccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgcccccgctggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcgccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagaccaagcacgccgtctcccgcggctcctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgcaagcacggcggcaacctcgtccgctgccccctctcccgcaactccacccacgagatgtactgggtctccggcgcctccggcaacatcgtctcctccgtcaacaccacctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatgatcatgaccaccaccgccaactggctctgggccctcctcggcaagaagaagaacccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggagatcgacaagaaggacggcgacctcatgtacgccgacgacaccgccggctgggacacccgcatcaccgaggacgacctccagaacgaggagctcatcaccgagcagatggccccccaccacaagatcctcgccaaggccatcttcaagctcacctaccagaacaaggtcgtcaaggtcctccgccccaccccccgcggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctccgcgagtgcggcgtcgaccgcctcaagcgcatggccatctccggcgacgactgcgtcgtcaagcccctcgacgagcgcttcggcacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgaccgacaagacccccatccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgtcatgaagcgctactccgccccctccgagtccgagggcgtcctctga

SEQ ID NO: 13074 - RNA, 9867 nt, synthetic construct
  misc_feature 1..9867: note = derived and/or modified CDS sequence (opt2) from DENV-4__GQ199880__SS-prME
  source 1..9867: mol_type = other RNA
tccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggcctccatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccgccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctcctccacccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggtccggccgcgagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgtctccgacctcaagtactcctggaagacctggggcaaggccaagatcttcacccccgaggcccgcaactccaccttcctcatcgacggccccgacacctccgagtgccccaacgagcgccgcgcctggaactccctcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagaaggcctccctcatcgaggtcaagacctgcctctggcccaagacccacaccctctggtccaacggcgtcctcgagtcccagatgctcatccccaagtcctacgccggccccttctcccagcacaactaccgccagggctacgccacccagaccgtcggcccctggcacctcggcaagctcgagatcgacttcggcgagtgccccggcaccaccgtcaccatccaggaggactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctcaacgagaaggaggagaacatggtcaagtcccaggtcaccgccggccagggcacctccgagaccttctccatgggcctcctctgcctcaccctcttcgtcgaggagtgcctccgccgccgcgtcacccgcaagcacatgatcctcgtcgtcgtcatcaccctctgcgccatcatcctcggcggcctcacctggatggacctcctccgcgccctcatcatgctcggcgacaccatgtccggccgcatcggcggccagatccacctcgccatcatggccgtcttcaagatgtcccccggctacgtcctcggcgtcttcctccgcaagctcacctcccgcgagaccgccctcatggtcatcggcatggccatgaccaccgtcctctccatcccccacgacctcatggagctcatcgacggcatctccctcggcctcatcctcctcaagatcgtcacccagttcgacaacacccaggtcggcaccctcgccctctccctcaccttcatccgctccaccatgcccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccgtcaccatgaccctctggtacatgtggcaggtcaagacccagcgctccggcgccctctgggacgtcccctcccccgccgccacccagaaggccgccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgcccccgctggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcgccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagaccaagcacgccgtctcccgcggctcctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgcaagcacggcggcaacctcgtccgctgccccctctcccgcaactccacccacgagatgtactgggtctccggcgcctccggcaacatcgtctcctccgtcaacaccacctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatgatcatgaccaccaccgccaactggctctgggccctcctcggcaagaagaagaacccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggagatcgacaagaaggacggcgacctcatgtacgccgacgacaccgccggctgggacacccgcatcaccgaggacgacctccagaacgaggagctcatcaccgagcagatggccccccaccacaagatcctcgccaaggccatcttcaagctcacctaccagaacaaggtcgtcaaggtcctccgccccaccccccgcggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctccgcgagtgcggcgtcgaccgcctcaagcgcatggccatctccggcgacgactgcgtcgtcaagcccctcgacgagcgcttcggcacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgaccgacaagacccccatccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgtcatgaagcgctactccgccccctccgagtccgagggcgtcctctga

SEQ ID NO: 13075 - RNA, 9867 nt, synthetic construct
  misc_feature 1..9867: note = derived and/or modified CDS sequence (opt2) from DENV-4__GQ252675__SS-prME
  source 1..9867: mol_type = other RNA
tccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggcctccatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccgccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaagatccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctcctccacccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggtccggccgcgagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgtctccgacctcaagtactcctggaagacctggggcaaggccaagatcttcacccccgaggcccgcaactccaccttcctcatcgacggccccgacacctccgagtgccccaacgagcgccgcgcctggaactccctcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagaaggcctccctcatcgaggtcaagacctgcctctggcccaagacccacaccctctggtccaacggcgtcctcgagtcccagatgctcatccccaagtcctacgccggccccttctcccagcacaactaccgccagggctacgccacccagaccgtcggcccctggcacctcggcaagctcgagatcgacttcggcgagtgccccggcaccaccgtcaccatccaggaggactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctcaacgagaaggaggagaacatggtcaagtcccaggtcaccgccggccagggcacctccgagaccttctccatgggcctcctctgcctcaccctcttcgtcgaggagtgcctccgccgccgcgtcacccgcaagcacatgatgctcgtcgtcgtcatcaccctctgcgccatcatcctcggcggcctcacctggatggacctcctccgcgccctcatcatgctcggcgacaccatgtccggccgcatcggcggccagatccacctcgccatcatggccgtcttcaagatgtcccccggctacgtcctcggcgtcttcctccgcaagctcacctcccgcgagaccgccctcatggtcatcggcatggccatgaccaccgtcctctccatcccccacgacctcatggagctcatcgacggcatctccctcggcctcatcctcctcaagaccgtcacccagttcgacaacacccaggtcggcaccctcgccctctccctcaccttcatccgctccaccatgcccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccgtcaccatgaccctctggtacatgtggcaggtcaagacccagcgctccggcgccctctgggacgtcccctcccccgccgccacccagaaggccgccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaacaagaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgcccccgctggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcgccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagaccaagcacgccgtctcccgcggctcctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgcaagcacggcggcaacctcgtccgctgccccctctcccgcaactccacccacgagatgtactgggtctccggcgcctccggcaacatcgtctcctccgtcaacaccacctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatgatcatgaccaccaccgccaactggctctgggccctcctcggcaagaagaagaacccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggagatcgacaagaaggacggcgacctcatgtacgccgacgacaccgccggctgggacacccgcatcaccgaggacgacctccagaacgaggagctcatcaccgagcagatggccccccaccacaagatcctcgccaaggccatcttcaagctcacctaccagaacaaggtcgtcaaggtcctccgccccaccccccgcggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctccgcgagtgcggcgtcgaccgcctcaagcgcatggccatctccggcgacgactgcgtcgtcaagcccctcgacgagcgcttcggcacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgaccgacaagacccccatccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgtcatgaagcgctactccgccccctccgagtccgagggcgtcctctga

SEQ ID NO: 13076 - RNA, 9867 nt, synthetic construct
  misc_feature 1..9867: note = derived and/or modified CDS sequence (opt2) from DENV-4__FJ810417__SS-prME
  source 1..9867: mol_type = other RNA
tccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggcctccatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccgccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctcctccatccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggtccggccgcgagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgtctccgacctcaagtactcctggaagacctggggcaaggccaagatcttcacccccgaggcccgcaactccaccttcctcatcgacggccccgacacctccgagtgccccaacgagcgccgcgcctggaactccctcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagaaggcctccctcatcgaggtcaagacctgcctctggcccaagacccacaccctctggtccaacggcgtcctcgagtcccagatgctcatccccaagtcctacgccggccccttctcccagcacaactaccgccagggctacgccacccagaccgtcggcccctggcacctcggcaagctcgagatcgacttcggcgagtgccccggcaccaccgtcaccatccaggaggactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctcaacgagaaggaggagaacatggtcaagtcccaggtcaccgccggccagggcacctccgagaccttctccatgggcctcctctgcctcaccctcttcgtcgaggagtgcctccgccgccgcgtcacccgcaagcacatgatcctcgtcgtcgtcatcaccctctgcgccatcatcctcggcggcctcacctggatggacctcctccgcgccctcatcatgctcggcgacaccatgtccggccgcatcggcggccagatccacctcgccatcatggccgtcttcaagatgtcccccggctacgtcctcggcgtcttcctccgcaagctcacctcccgcgagaccgccctcatggtcatcggcatggccatgaccaccgtcctctccatcccccacgacctcatggagctcatcgacggcatctccctcggcctcatcctcctcaagatcgtcacccagttcgacaacacccaggtcggcaccctcgccctctccctcaccttcatccgctccaccatgcccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccgtcaccatgaccctctggtacatgtggcaggtcaagacccagcgctccggcgccctctgggacgtcccctcccccgccgccacccagaaggccgccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgcccccgctggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcgccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagaccaagcacgccgtctcccgcggctcctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgcaagcacggcggcaacctcgtccgctgccccctctcccgcaactccacccacgagatgtactgggtctccggcgcctccggcaacatcgtctcctccgtcaacaccacctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatgatcatgaccaccaccgccaactggctctgggccctcctcggcaagaagaagaacccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggagatcgacaagaaggacggcgacctcatgtacgccgacgacaccgccggctgggacacccgcatcaccgaggacgacctccagaacgaggagctcatcaccgagcagatggccccccaccacaagatcctcgccaaggccatcttcaagctcacctaccagaacaaggtcgtcaaggtcctccgccccaccccccgcggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctccgcgagtgcggcgtcgaccgcctcaagcgcatggccatctccggcgacgactgcgtcgtcaagcccctcgacgagcgcttcggcacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgaccgacaagacccccatccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgtcatgaagcgctactccgccccctccgagtccgagggcgtcctctga

SEQ ID NO: 13077 - RNA, 9867 nt, synthetic construct
  misc_feature 1..9867: note = derived and/or modified CDS sequence (opt2) from DENV-4__FJ850057__SS-prME
  source 1..9867: mol_type = other RNA
tccaccatcaccctcctctgcctcatccccaccgccatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggcctccatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccgccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctcctccacccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggtccggccgcgagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgtctccgacctcaagtactcctggaagacctggggcaaggccaagatcttcacccccgaggcccgcaactccaccttcctcatcgacggccccgacacctccgagtgccccaacgagcgccgcgcctggaactccctcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagaaggcctccctcatcgaggtcaagacctgcctctggcccaagacccacaccctctggtccaacggcgtcctcgagtcccagatgctcatccccaagtcctacgccggccccttctcccagcacaactaccgccagggctacgccacccagaccgtcggcccctggcacctcggcaagctcgagatcgacttcggcgagtgccccggcaccaccgtcaccatccaggaggactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctcaacgagaaggaggagaacatggtcaagtcccaggtcaccgccggccagggcacctccgagaccttctccatgggcctcctctgcctcaccctcttcgtcgaggagtgcctccgccgccgcgtcacccgcaagcacatgatcctcgtcgtcgtcatcaccctctgcgccatcatcctcggcggcctcacctggatggacctcctccgcgccctcatcatgctcggcgacaccatgtccggccgcatcggcggccagatccacctcgccatcatggccgtcttcaagatgtcccccggctacgtcctcggcgtcttcctccgcaagctcacctcccgcgagaccgccctcatggtcatcggcatggccatgaccaccgtcctctccatcccccacgacctcatggagctcatcgacggcatctccctcggcctcatcctcctcaagatcgtcacccagttcgacaacacccaggtcggcaccctcgccctctccctcaccttcatccgctccaccatgcccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccgtcaccatgaccctctggtacatgtggcaggtcaagacccagcgctccggcgccctctgggacgtcccctcccccgccgccacccagaaggccgccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgcccccgctggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcgccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccttctgcgaggtcctcaccctcgccaccggccccaccctcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagaccaagcacgccgtctcccgcggctcctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgcaagcacggcggcaacctcgtccgctgccccctctcccgcaactccacccacgagatgtactgggtctccggcgcctccggcaacatcgtctcctccgtcaacaccacctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatgatcatgaccaccaccgccaactggctctgggccctcctcggcaagaagaagaacccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggagatcgacaagaaggacggcgacctcatgtacgccgacgacaccgccggctgggacacccgcatcaccgaggacgacctccagaacgaggagctcatcaccgagcagatggccccccaccacaagatcctcgccaaggccatcttcaagctcacctaccagaacaaggtcgtcaaggtcctccgccccaccccccgcggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctccgcgagtgcggcgtcgaccgcctcaagcgcatggccatctccggcgacgactgcgtcgtcaagcccctcgacgagcgcttcggcacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgaccgacaagacccccatccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgtcatgaagcgctactccgccccctccgagtccgagggcgtcctctga

SEQ ID NO: 13078 - RNA, 9867 nt, synthetic construct
  misc_feature 1..9867: note = derived and/or modified CDS sequence (opt2) from DENV-4__GQ199881__SS-prME
  source 1..9867: mol_type = other RNA
tccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagacccgcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggcctccatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccgccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctcctccacccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggtccggccgcgagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgtctccgacctcaagtactcctggaagacctggggcaaggccaagatcttcacccccgaggcccgcaactccaccttcctcatcgacggccccgacacctccgagtgccccaacgagcgccgcgcctggaactccctcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagaaggcctccctcatcgaggtcaagacctgcctctggcccaagacccacaccctctggtccaacggcgtcctcgagtcccagatgctcatccccaagtcctacgccggccccttctcccagcacaactaccgccagggctacgccacccagaccgtcggcccctggcacctcggcaagctcgagatcgacttcggcgagtgccccggcaccaccgtcaccatccaggaggactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcgccgccggccagggcacctccgagaccttcttcatgggcctcctctgcctcaccctcttcgtcgaggagtgcctccgccgccgcgtcacccgcaagcacatgatcctcgccgtcgtcatcaccctctgcgccatcatcctcggcggcctcacctggatggacctcctccgcgccctcatcatgctcggcgacaccatgtccggccgcatcggcggccagacccacctcgccatcatggccgtcttcaagatgtcccccggctacgtcctcggcgtcttcctccgcaagctcacctcccgcgagaccgccctcatggtcatcggcatggccatgaccaccaccctctccatcccccacgacctcatggagctcatcgacggcatctccctcggcctcatcctcctcaagatcgtcacccagttcgacaacacccaggtcggcaccctcgccctctccctcaccttcatccgctccaccatgtccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatgatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccgtcaccatgaccctctggtacatgtggcaggtcaagacccagcgctccggcgccctctgggacgtcccctcccccgccgccacccagaaggccgccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggctcctccggctcccccatcatcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgcccccgctggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcaccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcgccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagcacgccgtctcccgcggctcctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgcaagcacggcggcaacctcgtccgctgccccctctcccgcaactccacccacgagatgtactgggtctccggcgcctccggcaacatcgtctcctccgtcaacaccacctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatggtcatgaccaccaccgccaactggctctgggccctcctcggcaagaagaagaacccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggagatcgacaagaaggacggcgacctcatgtacgccgacgacaccgccggctgggacacccgcatcaccgaggacgacctccagaacgaggagctcatcaccgagcagatggccccccaccacaagatcctcgccaaggccatcttcaagctcacctaccagaacaaggtcgtcaaggtcctccgccccaccccccgcggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctccgcgagtgcggcgtcgaccgcctcaagcgcatggccatctccggcgacgactgcgtcgtcaagcccctcgacgagcgcttcggcacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgatcgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgtcatgaagcgctactccgccccctccgagtccgagggcgtcctctga

SEQ ID NO: 13079 - RNA, 9867 nt, synthetic construct
  misc_feature 1..9867: note = derived and/or modified CDS sequence (opt2) from DENV-4__GQ199882__SS-prME
  source 1..9867: mol_type = other RNA
tccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggcctccatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccgccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctcctccacccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggtccggccgcgagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgtctccgacctcaagtactcctggaagacctggggcaaggccaagatcttcacccccgaggcccgcaactccaccttcctcatcgacggccccgacacctccgagtgccccaacgagcgccgcgcctggaactccctcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagaaggcctccctcatcgaggtcaagacctgcctctggcccaagacccacaccctctggtccaacggcgtcctcgagtcccagatgctcatccccaagtcctacgccggccccttctcccagcacaactaccgccagggctacgccacccagaccgtcggcccctggcacctcggcaagctcgagatcgacttcggcgagtgccccggcaccaccgtcaccatccaggaggactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcgccgccggccagggcacctccgagaccttctccatgggcctcctctgcctcaccctcttcgtcgaggagtgcctccgccgccgcgtcacccgcaagcacatgatcctcgccgtcgtcatcaccctctgcgccatcatcctcggcggcctcacctggatggacctcctccgcgccctcatcatgctcggcgacaccatgtccggccgcatcggcggccagacccacctcgccatcatggccgtcttcaagatgtcccccggctacgtcctcggcgtcttcctccgcaagctcacctcccgcgagaccgccctcatggtcatcggcatggccatgaccaccaccctctccatcccccacgacctcatggagctcatcgacggcatctccctcggcctcatcctcctcaagatcgtcacccagttcgacaacacccaggtcggcaccctcgccctctccctcaccttcatccgctccaccatgtccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccgtcaccatgaccctctggtacatgtggcaggtcaagacccagcgctccggcgccctctgggacgtcccctcccccgccgccacccagaaggccgccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggctccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgcccccgctggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcaccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagcacgccgtctcccgcggctcctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgcaagcacggcggcaacctcgtccgctgccccctctcccgcaactccacccacgagatgtactgggtctccggcgcctccggcaacatcgtctcctccgtcaacaccacctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatggtcatgaccaccaccgccaactggctctgggccctcctcggcaagaagaagaacccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggagatcgacaagaaggacggcgacctcatgtacgccgacgacaccgccggctgggacacccgcatcaccgaggacgacctccagaacgaggagctcatcaccgagcagatggccccccaccacaagatcctcgccaaggccatcttcaagctcacctaccagaacaaggtcgtcaaggtcctccgccccaccccccgcggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctccgcgagtgcggcgtcgaccgcctcaagcgcatggccatctccggcgacgactgcgtcgtcaagcccctcgacgagcgcttcggcacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgatcgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgtcatgaagcgctactccgccccctccgagtccgagggcgtcctctga

SEQ ID NO: 13080 - RNA, 9867 nt, synthetic construct
  misc_feature 1..9867: note = derived and/or modified CDS sequence (opt2) from DENV-4__GQ199883__SS-prME
  source 1..9867: mol_type = other RNA
tccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggcctccatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgccgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccgccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctcctccacccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggtccggccgcgagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgtctccgacctcaagtactcctggaagacctggggcaaggccaagatcttcacccccgaggcccgcaactccaccttcctcatcgacggccccgacacctccgagtgccccaacgagcgccgcgcctggaactccctcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagaaggcctccctcatcgaggtcaagacctgcctctggcccaagacccacaccctctggtccaacggcgtcctcgagtcccagatgctcatccccaagtcctacgccggccccttctcccagcacaactaccgccagggctacgccacccagaccgtcggcccctggcacctcggcaagctcgagatcgacttcggcgagtgccccggcaccaccgtcaccatccaggaggactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcgccgccggccagggcacctccgagaccttctccatgggcctcctctgcctcaccctcttcgtcgaggagtgcctccgccgccgcgtcacccgcaagcacatgatcctcgccgtcgtcatcaccctctgcgccatcatcctcggcggcctcacctggatggacctcctccgcgccctcatcatgctcggcgacaccatgtccggccgcatcggcggccagacccacctcgccatcatggccgtcttcaagatgtcccccggctacgtcctcggcgtcttcctccgcaagctcacctcccgcgagaccgccctcatggtcatcggcatggccatgaccaccaccctctccatcccccacgacctcatggagctcatcgacggcatctccctcggcctcatcctcctcaagatcgtcacccagttcgacaacacccaggtcggcaccctcgccctctccctcaccttcatccgctccaccatgtccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccgtcaccatgaccctctggtacatgtggcaggtcaagacccagcgctccggcgccctctgggacgtcccctcccccgccgccacccagaaggccgccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgcccccgctggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcaccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcgccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagcacgccgtctcccgcggctcctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgcaagcacggcggcaacctcgtccgctgccccctctcccgcaactccacccacgagatgtactgggtctccggcgcctccggcaacatcgtctcctccgtcaacaccacctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatggtcatgaccaccaccgccaactggctctgggccctcctcggcaagaagaagaacccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggagatcgacaagaaggacggcgacctcatgtacgccgacgacaccgccggctgggacacccgcatcaccgaggacgacctccagaacgaggagctcatcaccgagcagatggccccccaccacaagatcctcgccaaggccatcttcaagctcacctaccagaacaaggtcgtcaaggtcctccgccccaccccccgcggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctccgcgagtgcggcgtcgaccgcctcaagcgcatggccatctccggcgacgactgcgtcgtcaagcccctcgacgagcgcttcggcacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgatcgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgtcatgaagcgctactccgccccctccgagtccgagggcgtcctctga

SEQ ID NO: 13081 - RNA, 9867 nt, synthetic construct
  misc_feature 1..9867: note = derived and/or modified CDS sequence (opt2) from DENV-4__GQ199884__SS-prME
  source 1..9867: mol_type = other RNA
tccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggcctccatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccgccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctcctccacccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggtccggccgcgagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgtctccgacctcaagtactcctggaagacctggggcaaggccaagatcttcacccccgaggcccgcaactccaccttcctcatcgacggccccgacacctccgagtgccccaacgagcgccgcgcctggaactccctcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagaaggcctccctcatcgaggtcaagacctgcctctggcccaagacccacaccctctggtccaacggcgtcctcgagtcccagatgctcatccccaagtcctacgccggccccttctcccagcacaactaccgccagggctacgccacccagaccgtcggcccctggcacctcggcaagctcgagatcgacttcggcgagtgccccggcaccaccgtcaccatccaggaggactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcgccgccggccagggcacctccgagaccttctccatgggcctcctctgcctcaccctcttcgtcgaggagtgcctccgccgccgcgtcacccgcaagcacatgatcctcgccgtcgtcatcaccctctgcgccatcatcctcggcggcctcacctggatggacctcctccgcgccctcatcatgctcggcgacaccatgtccggccgcatcggcggccagacccacctcgccatcatggccgtcttcaagatgtcccccggctacgtcctcggcgtcttcctccgcaagctcacctcccgcgagaccgccctcatggtcatcggcatggccatgaccaccaccctctccatcccccacgacctcatggagctcatcgacggcatctccctcggcctcatcctcctcaagatcgtcacccagttcgacaacacccaggtcggcaccctcgccctctccctcaccttcatccgctccaccatgtccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccgtcaccatgaccctctggtacatgtggcaggtcaagacccagcgctccggcgccctctgggacgtcccctcccccgccgccacccagaaggccgccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgcccccgctggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcaccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcgccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagcacgccgtctcccgcggctcctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgcaagcacggcggcaacctcgtccgctgccccctctcccgcaactccacccacgagatgtactgggtctccggcgcctccggcaacatcgtctcctccgtcaacaccacctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatggtcatgaccaccaccgccaactggctctgggccctcctcggcaagaagaagaacccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggagatcgacaagaaggacggcgacctcatgtacgccgacgacaccgccggctgggacacccgcatcaccgaggacgacctccagaacgaggagctcatcaccgagcagatggccccccaccacaagatcctcgccaaggccatcttcaagctcacctaccagaacaaggtcgtcaaggtcctccgccccaccccccgcggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctccgcgagtgcggcgtcgaccgcctcaagcgcatggccatctccggcgacgactgcgtcgtcaagcccctcgacgagcgcttcggcacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgatcgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgtcatgaagcgctactccgccccctccgagtccgagggcgtcctctga

SEQ ID NO: 13082 - RNA, 9867 nt, synthetic construct
  misc_feature 1..9867: note = derived and/or modified CDS sequence (opt2) from DENV-4__FJ882595__SS-prME
  source 1..9867: mol_type = other RNA
tccaccatcaccctcctctgcctcatccccaccgccatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggcctccatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccgccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctcctccacccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggtccggccgcgagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgtctccgacctcaagtactcctggaagacctggggcaaggccaagatcttcacccccgaggcccgcaactccaccttcctcatcgacggccccgacacctccgagtgccccaacgagcgccgcgcctggaactccctcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagaaggcctccctcatcgaggtcaagacctgcctctggcccaagacccacaccctctggtccaacggcgtcctcgagtcccagatgctcatccccaagtcctacgccggccccttctcccagcacaactaccgccagggctacgccacccagaccgtcggcccctggcacctcggcaagctcgagatcgacttcggcgagtgccccggcaccaccgtcaccatccaggaggactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcgccgccggccagggcacctccgagaccttctccatgggcctcctctgcctcaccctcttcgtcgaggagtgcctccgccgccgcgtcacccgcaagcacatgatcctcgccgtcgtcatcaccctctgcgccatcatcctcggcggcctcacctggatggacctcctccgcgccctcatcatgctcggcgacaccatgtccggccgcatcggcggccagacccacctcgccatcatggccgtcttcaagatgtcccccggctacgtcctcggcgtcttcctccgcaagctcacctcccgcgagaccgccctcatggtcatcggcatggccatgaccaccaccctctccatcccccacgacctcatggagctcatcgacggcatctccctcggcctcatcctcctcaagatcgtcacccagttcgacaacacccaggtcggcaccctcgccctctccctcaccttcatccgctccaccatgtccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccgtcaccatgaccctctggtacatgtggcaggtcaagacccagcgctccggcgccctctgggacgtcccctcccccgccgccacccagaaggccgccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgcccccgctggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggccgcgcctaccagcacgccctcaacgagctccccgagtccctcgagaccctcatgctcgtcgccctcctcggcgccatgaccgccggcatcttcctcttcttcatgcagggcaccggcatcggcaagctctccatgggcctcatcaccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagcacgccgtctcccgcggctcctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgcaagcacggcggcaacctcgtccgctgccccctctcccgcaactccacccacgagatgtactgggtctccggcgcctccggcaacatcgtctcctccgtcaacaccacctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatggtcatgaccaccaccgccaactggctctgggccctcctcggcaagaagaagaacccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggagatcgacaagaaggacggcgacctcatgtacgccgacgacaccgccggctgggacacccgcatcaccgaggacgacctccagaacgaggagctcatcaccgagcagatggccccccaccacaagatcctcgccaaggccatcttcaagctcacctaccagaacaaggtcgtcaaggtcctccgccccaccccccgcggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctccgcgagtgcggcgtcgaccgcctcaagcgcatggccatctccggcgacgactgcgtcgtcaagcccctcgacgagcgcttcggcacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgatcgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgtcatgaagcgctactccgccccctccgagtccgagggcgtcctctga

SEQ ID NO: 13083 - RNA, 9867 nt, synthetic construct
  misc_feature 1..9867: note = derived and/or modified CDS sequence (opt2) from DENV-4__FJ882596__SS-prME
  source 1..9867: mol_type = other RNA
tccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggcctccatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccgccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctcctccacccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggtccggccgcgagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtccgcggcgtcctcaccaagggcaagcgcgccctcaccccccccgtctccgacctcaagtactcctggaagacctggggcaaggccaagatcttcacccccgaggcccgcaactccaccttcctcatcgacggccccgacacctccgagtgccccaacgagcgccgcgcctggaactccctcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagaaggcctccctcatcgaggtcaagacctgcctctggcccaagacccacaccctctggtccaacggcgtcctcgagtcccagatgctcatccccaagtcctacgccggccccttctcccagcacaactaccgccagggctacgccacccagaccgtcggcccctggcacctcggcaagctcgagatcgacttcggcgagtgccccggcaccaccgtcaccatccaggaggactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcgccgccggccagggcacctccgagaccttctccatgggcctcctctgcctcaccctcttcgtcgaggagtgcctccgccgccgcgtcacccgcaagcacatgatcctcgccgtcgtcatcaccctctgcgccatcatcctcggcggcctcacctggatggacctcctccgcgccctcatcatgctcggcgacaccatgtccggccgcatcggcggccagacccacctcgccatcatggccgtcttcaagatgtcccccggctacgtcctcggcgtcttcctccgcaagctcacctcccgcgagaccgccctcatggtcatcggcatggccatgaccaccaccctctccatcccccacgacctcatggagctcatcgacggcatctccctcggcctcatcctcctcaagatcgtcacccagttcgacaacacccaggtcggcaccctcgccctctccctcaccttcatccgctccaccatgtccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccgtcaccatgaccctctggtacatgtggcaggtcaagacccagcgctccggcgccctctgggacgtcccctcccccgccgccacccagaaggccgccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgcccccgctggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcaccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagcacgccgtctcccgcggctcctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgcaagcacggcggcaacctcgtccgctgccccctctcccgcaactccacccacgagatgtactgggtctccggcgcctccggcaacatcgtctcctccgtcaacaccacctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatggtcatgaccaccaccgccaactggctctgggccctcctcggcaagaagaagaacccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggagatcgacaagaaggacggcgacctcatgtacgccgacgacaccgccggctgggacacccgcatcaccgaggacgacctccagaacgaggagctcatcaccgagcagatggccccccaccacaagatcctcgccaaggccatcttcaagctcacctaccagaacaaggtcgtcaaggtcctccgccccaccccccgcggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctccgcgagtgcggcgtcgaccgcctcaagcgcatggccatctccggcgacgactgcgtcgtcaagcccctcgacgagcgcttcggcacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgatcgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgtcatgaagcgctactccgccccctccgagtccgagggcgtcctctga

SEQ ID NO: 13084 - RNA, 9867 nt, synthetic construct
  misc_feature 1..9867: note = derived and/or modified CDS sequence (opt2) from DENV-4__FJ850059__SS-prME
  source 1..9867: mol_type = other RNA
tccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgtctgggtcgacctcgtcctcgagcacggcggctgcgtcaccaccatggcccagggcaagcccaccctcgacttcgagctcaccaagaccaccgccaaggaggtcgccctcctccgcacctactgcatcgaggcctccatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccgccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctcctccacccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggtccggccgcgagctcaagtgcggctccggcatcttcgtcgtcgacaacgtccacacctggaccgagcagtacaagttccagcccgagtcccccgcccgcctcgcctccgccatcctcatcgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgccaagggcgtcctcaccaagggcaagcgcgccctcaccccccccgtctccgacctcaagtactcctggaagacctggggcaaggccaagatcttcacccccgaggcccgcaactccaccttcctcatcgacggccccgacacctccgagtgccccaacgagcgccgcgcctggaactccctcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagaaggcctccctcatcgaggtcaagacctgcctctggcccaagacccacaccctctggtccaacggcgtcctcgagtcccagatgctcatccccaagtcctacgccggccccttctcccagcacaactaccgccagggctacgccacccagaccgtcggcccctggcacctcggcaagctcgagatcgacttcggcgagtgccccggcaccaccgtcaccatccaggaggactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcaccgccggccagggcacctccgagaccttctccatgggcctcctctgcctcaccctcttcgtcgaggagtgcctccgccgccgcgtcacccgcaagcacatgatcctcgccgtcgtcatcaccctctgcgccatcatcctcggcggcctcacctggatggacctcctccgcgccctcatcatgctcggcgacaccatgtccggccgcatcggcggccagacccacctcgccatcatggccgtcttcaagatgtcccccggctacgtcctcggcgtcttcctccgcaagctcacctcccgcgagaccgccctcatggtcatcggcatggccatgaccaccaccctctccatcccccacgacctcatggagctcatcgacggcatctccctcggcctcatcctcctcaagatcgtcacccagttcgacaacacccaggtcggcaccctcgccctctccctcaccttcatccgctccaccatgtccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccgtcaccatgaccctctggtacatgtggcaggtcaagacccagcgctccggcgccctctgggacgtcccctcccccgccgccacccagaaggccgccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgcccccgctggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcaccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagcacgccgtctcccgcggctcctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctaccgccccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgcaagcacggcggcaacctcgtccgctgccccctctcccgcaactccacccacgagatgtactgggtctccggcgcctccggcaacatcgtctcctccgtcaacaccacctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatggtcatgaccaccaccgccaactggctctgggccctcctcggcaagaagaagaacccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggagatcgacaagaaggacggcgacctcatgtacgccgacgacaccgccggctgggacacccgcatcaccgaggacgacctccagaacgaggagctcatcaccgagcagatggccccccaccacaagatcctcgccaaggccatcttcaagctcacctaccagaacaaggtcgtcaaggtcctccgccccaccccccgcggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctccgcgagtgcggcgtcgaccgcctcaagcgcatggccatctccggcgacgactgcgtcgtcaagcccctcgacgagcgcttcggcacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgatcgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgtcatgaagcgctactccgccccctccgagtccgagggcgtcctctga

SEQ ID NO: 13085 - RNA, 9867 nt, synthetic construct
  misc_feature 1..9867: note = derived and/or modified CDS sequence (opt2) from DENV-4__FJ882598__SS-prME
  source 1..9867: mol_type = other RNA
tccaccatcaccctcctctgcctcatccccaccgccatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggcctccatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccgccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctcctccacccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggtccggccgcgagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgtctccgacctcaagtactcctggaagacctggggcaaggccaagatcttcacccccgaggcccgcaactccaccttcctcatcgacggccccgacacctccgagtgccccaacgagcgccgcgcctggaactccctcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagaaggcctccctcatcgaggtcaagacctgcctctggcccaagacccacaccctctggtccaacggcgtcctcgagtcccagatgctcatccccaagtcctacgccggccccttctcccagcacaactaccgccagggctacgccacccagaccgtcggcccctggcacctcggcaagctcgagatcgacttcggcgagtgccccggcaccaccgtcaccatccaggaggactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcgccgccggccagggcacctccgagaccttctccatgggcctcctctgcctcaccctcttcgtcgaggagtgcctccgccgccgcgtcacccgcaagcacatgatcctcgccgtcgtcatcaccctctgcgccatcatcctcggcggcctcacctggatggacctcctccgcgccctcatcatgctcggcgacaccatgtccggccgcatcggcggccagacccacctcgccatcatggccgtcttcaagatgtcccccggctacgtcctcggcgtcttcctccgcaagctcacctcccgcgagaccgccctcatggtcatcggcatggccatgaccaccaccctctccatcccccacgacctcatggagctcatcgacggcatctccctcggcctcatcctcctcaagatcgtcacccagttcgacaacacccaggtcggcaccctcgccctctccctcaccttcatccgctccaccatgtccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccgtcaccatgaccctctggtacatgtggcaggtcaagacccagcgctccggcgccctctgggacgtcccctcccccgccgccacccagaaggccgccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgcccccgctggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcaccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagcacgccgtctcccgcggctcctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgcaagcacggcggcaacctcgtccgctgccccctctcccgcaactccacccacgagatgtactgggtctccggcgcctccggcaacatcgtctcctccgtcaacaccacctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatggtcatgaccaccaccgccaactggctctgggccctcctcggcaagaagaagaacccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggagatcgacaagaaggacggcgacctcatgtacgccgacgacaccgccggctgggacacccgcatcaccgaggacgacctccagaacgaggagctcatcaccgagcagatggccccccaccacaagatcctcgccaaggccatcttcaagctcacctaccagaacaaggtcgtcaaggtcctccgccccaccccccgcggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctccgcgagtgcggcgtcgaccgcctcaagcgcatggccatctccggcgacgactgcgtcgtcaagcccctcgacgagcgcttcggcacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgatcgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgtcatgaagcgctactccgccccctccgagtccgagggcgtcctctga

SEQ ID NO: 13086 - RNA, 9867 nt, synthetic construct
  misc_feature 1..9867: note = derived and/or modified CDS sequence (opt2) from DENV-4__FJ882601__SS-prME
  source 1..9867: mol_type = other RNA
tccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggcctccatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccgccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctcctccacccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggtccggccgcgagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgtctccgacctcaagtactcctggaagacctggggcaaggccaagatcttcacccccgaggcccgcaactccaccttcctcatcgacggccccgacacctccgagtgccccaacgagcgccgcgcctggaactccctcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagaaggcctccctcatcgaggtcaagacctgcctctggcccaagacccacaccctctggtccaacggcgtcctcgagtcccagatgctcatccccaagtcctacgccggccccttctcccagcacaactaccgccagggctacgccacccagaccgtcggcccctggcacctcggcaagctcgagatcgacttcggcgagtgccccggcaccaccgtcaccatccaggaggactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcgccgccggccagggcacctccgagaccttctccatgggcctcctctgcctcaccctcttcgtcgaggagtgcctccgccgccgcgtcacccgcaagcacatgatcctcgccgtcgtcatcaccctctgcgccatcatcctcggcggcctcacctggatggacctcctccgcgccctcatcatgctcggcgacaccatgtccggccgcatcggcggccagacccacctcgccatcatggccgtcttcaagatgtcccccggctacgtcctcggcgtcttcctccgcaagctcacctcccgcgagaccgccctcatggtcatcggcatggccatgaccaccaccctctccatcccccacgacctcatggagctcatcgacggcatctccctcggcctcatcctcctcaagatcgtcacccagttcgacaacacccaggtcggcaccctcgccctctccctcaccttcatccgctccaccatgtccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccgtcaccatgaccctctggtacatgtggcaggtcaagacccagcgctccggcgccctctgggacgtcccctcccccgccgccacccagaaggccgccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcgtcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgcccccgctggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcaccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcgccatcctcaccatcatcggcctcatcgccgccaacgagatgggcctcatcgagaagaccaagaccgacttcggcttctaccaggagaagaccgagaccaccatcctcgacgtcgacctccgccccgcctccgcctggaccctctacgccgtcgccaccaccatcctcacccccatgctccgccacaccatcgagaacacctccgccaacctctccctcaccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggccctcaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgccttctccctcatcaagaacgtccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagcacgccgtctcccgcggctcctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgcaagcacggcggcaacctcgtccgctgccccctctcccgcaactccacccacgagatgtactgggtctccggcgcctccggcaacatcgtctcctccgtcaacaccacctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatggtcatgaccaccaccgccaactggctctgggccctcctcggcaagaagaagaacccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggagatcgacaagaaggacggcgacctcatgtacgccgacgacaccgccggctgggacacccgcatcaccgaggacgacctccagaacgaggagctcgtcaccgagcagatggccccccaccacaagatcctcgccaaggccatcttcaagctcacctaccagaacaaggtcgtcaaggtcctccgccccaccccccgcggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctccgcgagtgcggcgtcgaccgcctcaagcgcatggccatctccggcgacgactgcgtcgtcaagcccctcgacgagcgcttcggcacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgatcgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgtcatgaagcgctactccgccccctccgagtccgagggcgtcctctga

SEQ ID NO: 13087 - RNA, 9867 nt, synthetic construct
  misc_feature 1..9867: note = derived and/or modified CDS sequence (opt2) from DENV-4__FJ226067__SS-prME
  source 1..9867: mol_type = other RNA
tccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggcctccatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccgccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctcctccacccccctcgccgagaacaccaactccgtcaccaacatcgagctcgagccccccttcggcgactcctacatcgtcatcggcgtcggcaactccgccctcaccctccactggttccgccgcggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcaccgtcggcggcatcaccctcttcctcggcttcaccgtccaggccgacatgggctgcgtcgtctcctggtccggccgcgagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgccctctgggagggcggccacgacctcaccgtcgtcgccggcgacgtcaagggcgtcctcaccaagggcaagcgcgccctcaccccccccgtctccgacctcaagtactcctggaagacctggggcaaggccaagatcttcacccccgaggcccgcaactccaccttcctcatcgacggccccgacacctccgagtgccccaacgagcgccgcgcctggaactccctcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagaaggcctccctcatcgaggtcaagacctgcctctggcccaagacccacaccctctggtccaacggcgtcctcgagtcccagatgctcatccccaagtcctacgccggccccttctcccagcacaactaccgccagggctacgccacccagaccgtcggcccctggcacctcggcaagctcgagatcgacttcggcgagtgccccggcaccaccgtcaccatccaggaggactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcaccgccggccagggcacctccgagaccttctccatgggcctcctctgcctcaccctcttcgtcgaggagtgcctccgccgccgcgtcacccgcaagcacatgatcctcgtcgtcgtcatcaccctctgcgccatcatcctcggcggcctcacctggatggacctcctccgcgccctcatcatgctcggcgacaccatgtccggccgcatcggcggccagatccacctcgccatcatggccgtcttcaagatgtcccccggctacgtcctcggcgtcttcctccgcaagctcacctcccgcgagaccgccctcatggtcatcggcatggccatgaccaccgtcctctccatcccccacgacctcatggagctcatcgacggcatctccctcggcctcatcctcctcaagatcgtcacccagttcgacaacacccaggtcggcaccctcgccctctccctcaccttcatccgctccaccatgcccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccgtcaccatgaccctctggtacatgtggcaggtcaagacccagcgctccggcgccctctgggacgtcccctcccccgccgccacccagaaggccgccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgcccccgctggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcgccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagcacgccgtctcccgcggctcctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgcaagcacggcggcaacctcgtccgctgccccctctcccgcaactccacccacgagatgtactgggtctccggcgcctccggcaacatcgtctcctccgtcaacaccacctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatggtcatgaccaccaccgccaactggctctgggccctcctcggcaagaagaagaacccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggagatcgacaagaaggacggcgacctcatgtacgccgacgacaccgccggctgggacacccgcatcaccgaggacgacctccagaacgaggagctcatcaccgagcagatggccccccaccacaagatcctcgccaaggccatcttcaagctcacctaccagaacaaggtcgtcaaggtcctccgccccaccccccgcggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctccgcgagtgcggcgtcgaccgcctcaagcgcatggccatctccggcgacgactgcgtcgtcaagcccctcgacgagcgcttcggcacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgaccgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgtcatgaagcgctactccgccctctccgagtccgagggcgtcctctga

SEQ ID NO: 13088 - RNA, 9867 nt, synthetic construct
  misc_feature 1..9867: note = derived and/or modified CDS sequence (opt2) from DENV-4__EU854299__SS-prME
  source 1..9867: mol_type = other RNA
tccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggccctcatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccaccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctccgccacccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggtccggccgcgagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgcctccgacctcaagtactcctggaagacctggggcaaggccaagatcttcacccccgaggcccgcaactccaccttcctcatcgacggccccgacacctccgagtgccccaacgagcgccgcgcctggaactccttcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagcgcgcctccctcatcgaggtcaagacctgcctctggcccaagacccacaccctctggtccaacggcgtcctcgagtcccagatgctcatccccaagtcctacgccggccccttctcccagcacaactaccgccagggctacgccacccagaccgtcggcccctggcacctcggcaagctcgagatcgacttcggcgagtgccccggcaccaccgtcaccatccaggagaactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcaccgccggccagggcacctccgagaccttctccatgggcctcctctgcctcaccctcttcgtcgaggagtgcctccgccgccgcgtcacccgcaagcacatgatcctcgccgtcgtcatcaccctctgcgccatcatcctcggcggcctcacctggatggacctcctccgcgccctcatcatgctcggcgacaccatgtccggccgcatcggcggccagacccacctcgccatcatggccgtcttcaagatgtcccccggctacgtcctcggcgtcttcctccgcaagctcacctcccgcgagaccgccctcatggtcatcggcatggccatgaccaccaccctctccatcccccacgacctcatggagctcatcgacggcatctccctcggcctcatcctcctcaagatcgtcacccagttcgacaacacccaggtcggcaccctcgccctctccctcaccttcatccgctccaccatgtccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccatcaccatgaccctctggtacatgtggcaggtcaagacccagcgctccggcgccctctgggacgtcccctcccccgccgccacccagaaggccgccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgccccaagtggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcaccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagcacgccgtctcccgcggctcctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgcaagcacggcggcaacctcgtccgctgccccctctcccgcaactccacccacgagatgtactgggtctccggcgcctccggcaacatcgtctcctccgtcaacaccacctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatggtcatgaccaccaccgccaactggctctgggccctcctcggcaagaagaagaacccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggagatcgacaagaaggacggcgacctcatgtacgccgacgacaccgccggctgggacacccgcatcaccgaggacgacctccagaacgaggagctcatcaccgagcagatggccccccaccacaagatcctcgccaaggccatcttcaagctcacctaccagaacaaggtcgtcaaggtcctccgccccaccccccgcggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctccgcgagtgcggcgtcgaccgcctcaagcgcatggccatctccggcgacgactgcgtcgtcaagcccctcgacgagcgcttcggcacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgatcgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgtcatgaagcgctactccgccccctccgagtccgagggcgtcctctga

SEQ ID NO: 13089 - RNA, 9867 nt, synthetic construct
  misc_feature 1..9867: note = derived and/or modified CDS sequence (opt2) from DENV-4__FJ182016__SS-prME
  source 1..9867: mol_type = other RNA
tccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggccctcatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccaccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctccgccacccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggtccggccgcgagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgcctccgacctcaagtactcctggaagacctggggcaaggccaagatcttcacccccgaggcccgcaactccaccttcctcatcgacggccccgacacctccgagtgccccaacgagcgccgcgcctggaactccttcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagcgcgcctccctcatcgaggtcaagacctgcctctggcccaagacccacaccctctggtccaacggcgtcctcgagtcccagatgctcatccccaagtcctacgccggccccttctcccagcacaactaccgccagggctacgccacccagaccgtcggcccctggcacctcggcaagctcgagatcgacttcggcgagtgccccggcaccaccgtcaccatccaggagaactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcaccgccggccagggcacctccgagaccttctccatgggcctcctctgcctcaccctcttcgtcgaggagtgcctccgccgccgcgtcacccgcaagcacatgatcctcgccgtcgtcatcaccctctgcgccatcatcctcggcggcctcacctggatggacctcctccgcgccctcatcatgctcggcgacaccatgtccggccgcatcggcggccagacccacctcgccatcatggccgtcttcaagatgtcccccggctacgtcctcggcgtcttcctccgcaagctcacctcccgcgagaccgccctcatggtcatcggcatggccatgaccaccaccctctccatcccccacgacctcatggagctcatcgacggcatctccctcggcctcatcctcctcaagatcgtcacccagttcgacaacacccaggtcggcaccctcgccctctccctcaccttcatccgctccaccatgtccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccatcaccatgaccctctggtacatgtggcaggtcaagacccagcgctccggcgccctctgggacgtcccctcccccgccgccacccagaaggccgccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgccccaagtggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcaccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagcacgccgtctcccgcggctcctccaagatccgctggatcgtcgagcgcggcatggtcaagcccaagggcaaggtcgtcgacctcggctgcggccgcggcggctggtcctactacatggccaccctcaagaacgtcaccgaggtccgcggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgcaagcacggcggcaacctcgtccgctgccccctctcccgcaactccacccacgagatgtactgggtctccggcgcctccggcaacatcgtctcctccgtcaacaccacctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatggtcatgaccaccaccgccaactggctctgggccctcctcggcaagaagaagaacccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggagatcgacaagaaggacggcgacctcatgtacgccgacgacaccgccggctgggacacccgcatcaccgaggacgacctccagaacgaggagctcatcaccgagcagatggccccccaccacaagatcctcgccaaggccatcttcaagctcacctaccagaacaaggtcgtcaaggtcctccgccccaccccccgcggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctccgcgagtgcggcgtcgaccgcctcaagcgcatggccatctccggcgacgactgcgtcgtcaagcccctcgacgagcgcttcggcacctccctcctcttcctcaacgacatgggcaaggtccgcaaggacatcccccagtgggagccctccaagggctggaagaactggcaggaggtccccttctgctcccaccacttccaccgcatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgatcgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgtcatgaagcgctactccgccccctccgagtccgagggcgtcctctga

SEQ ID NO: 13090 - RNA, 9867 nt, synthetic construct
  misc_feature 1..9867: note = derived and/or modified CDS sequence (opt2) from DENV-4__EU854300__SS-prME
  source 1..9867: mol_type = other RNA
tccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggccctcatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccaccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctccgccacccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggaacggccgcgagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgcctccgacctcaagtactcctggaagacctggggcaaggccaagatcttcacccccgagacccgcaactccaccttcctcatcgacggccccgacacctccgagtgccccaacgagcgccgcgcctggaactccttcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagcgcgcctccctcatcgaggtcaagacctgcctctggcccaagacccacaccctctggtccaacggcgtcctcgagtcccagatgctcatccccaagtcctacgccggccccttctcccagcacaactaccgccagggctacgccacccagaccgtcggcccctggcacctcggcaagctcgagatcgacttcggcgagtgccccggcaccaccgtcaccatccaggagaactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcaccgccggccagggcacctccgagaccttctccatgggcctcctctgcctcaccctcttcgtcgaggagtgcctccgccgccgcgtcacccgcaagcacatgatcctcgccgtcgtcatcaccctctgcgccatcatcctcggcggcctcacctggatggacctcctccgcgccctcatcatgctcggcgacaccatgtccggccgcatcggcggccagacccacctcgccatcatggccgtcttcaagatgtcccccggctacgtcctcggcgtcttcctccgcaagctcacctcccgcgagaccgccctcatggtcatcggcatggccatgaccaccaccctctccatcccccacgacctcatggagctcatcgacggcatctccctcggcctcatcctcctcaagatcgtcacccagttcgacaacacccaggtcggcaccctcgccctctccctcaccttcatccgctccaccatgtccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccatcaccatgaccctctggtacatgtggcaggtcaagacccagcgctccggcgccctctgggacgtcccctcccccgccgccacccagaaggccgccctctccgagggcgtctaccgcatcatgcagcgcggcctcttcggcaagacccaggtcggcgtcggcatccacatcgagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaacctcgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgccccaagtggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcaccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaaggccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagcacgccgtctcccgcggctcctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgcaagcacggcggcaacctcgtccgctgccccctctcccgcaactccacccacgagatgtactgggtctccggcgcctccggcaacatcgtctcctccgtcaacaccacctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatggtcatgaccaccaccgccaactggctctgggccctcctcggcaagaagaagaacccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggagatcgacaagaaggacggcgacctcatgtacgccgacgacaccgccggctgggacacccgcatcaccgaggacgacctccagaacgaggagctcatcaccgagcagatggccccccaccacaagatcctcgccaaggccatcttcaagctcacctaccagaacaaggtcgtcaaggtcctccgccccaccccccgcggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctccgcgagtgcggcgtcgaccgcctcaagcgcatggccatctccggcgacgactgcgtcgtcaagcccctcgacgagcgcttcggcacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgatcgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgtcatgaagcgctactccgccccctccgagtccgagggcgtcctctga

SEQ ID NO: 13091 - RNA, 9867 nt, synthetic construct
  misc_feature 1..9867: note = derived and/or modified CDS sequence (opt2) from DENV-4__FJ182017__SS-prME
  source 1..9867: mol_type = other RNA
tccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccgcctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggccctcatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccaccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctccgccacccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggtccggccgcgagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgcctccgacctcaagtactcctggaagacctggggcaaggccaagatcttcacccccgaggcccgcaactccaccttcctcatcgacggccccgacacctccgagtgccccaacgagcgccgcgcctggaactccttcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagcgcgcctccctcatcgaggtcaagacctgcctctggcccaagacccacaccctctggtccaacggcgtcctcgagtcccagatgctcatccccaagtcctacgccggccccttctcccagcacaactaccgccagggctacgccacccagaccgtcggcccctggcacctcggcaagctcgagatcgacttcggcgagtgccccggcaccaccgtcaccatccaggagaactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcaccgccggccagggcacctccgagaccttctccatgggcctcctctgcctcaccctcttcgtcgaggagtgcctccgccgccgcgtcacccgcaagcacatgatcctcgccgtcgtcatcaccctctgcgccatcatcctcggcggcctcacctggatggacctcctccgcgccctcatcatgctcggcgacaccatgtccggccgcatcggcggccagacccacctcgccatcatggccgtcttcaagatgtcccccggctacgtcctcggcgtcttcctccgcaagctcacctcccgcgagaccgccctcatggtcatcggcatggccatgaccaccaccctctccatcccccacgacctcatggagctcatcgacggcatctccctcggcctcatcctcctcaagatcgtcacccagttcgacaacacccaggtcggcaccctcgccctctccctcaccttcatccgctccaccatgtccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccatcaccatgaccctctggtacatgtggcaggtcaagacccagcgctccggcgccctctgggacgtcccctcccccgccgccacccagaaggccgccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgccccaagtggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcaccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgccctctgcgccggccagctcctcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagcacgccgtctcccgcggctcctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgcaagcacggcggcaacctcgtccgctgccccctctcccgcaactccacccacgagatgtactgggtctccggcgcctccggcaacatcgtctcctccgtcaacaccacctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatggtcatgaccaccaccgccaactggctctgggccctcctcggcaagaagaagaacccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggagatcgacaagaaggacggcgacctcatgtacgccgacgacaccgccggctgggacacccgcatcaccgaggacgacctccagaacgaggagctcatcaccgagcagatggccccccaccacaagatcctcgccaaggccatcttcaagctcacctaccagaacaaggtcgtcaaggtcctccgccccaccccccgcggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctccgcgagtgcggcgtcgaccgcctcaagcgcatggccatctccggcgacgactgcgtcgtcaagcccctcgacgagcgcttcggcacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgatcgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgtcatgaagcgctactccgccccctccgagtccgagggcgtcctctga

SEQ ID NO: 13092 - RNA, 9867 nt, synthetic construct
  misc_feature 1..9867: note = derived and/or modified CDS sequence (opt2) from DENV-4__EU854301__SS-prME
  source 1..9867: mol_type = other RNA
tccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggcctccatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccaccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctccgccacccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccagatcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggtccggccgcgagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgcctccgacctcaagtactcctggaagacctggggcaaggccaagatcttcacccccgaggcccgcaactccaccttcctcatcgacggccccgacacctccgagtgccccaacgagcgccgcgcctggaactccttcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagcgcgcctccctcatcgaggtcaagacctgcctctggcccaagacccacaccctctggtccaacggcgtcctcgagtcccagatgctcatccccaagtcctacgccggccccttctcccagcacaactaccgccagggctacgccacccagaccgtcggcccctggcacctcggcaagctcgagatcgacttcggcgagtgccccggcaccaccgtcaccatccaggagaactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcaccgccggccagggcacctccgagaccttctccatgggcctcctctgcctcaccctcttcgtcgaggagtgcctccgccgccgcgtcacccgcaagcacatgatcctcgccgtcgtcatcaccctctgcgccatcatcctcggcggcctcacctggatggacctcctccgcgccctcatcatgctcggcgacaccatgtccggccgcatcggcggccagacccacctcgccatcatggccgtcttcaagatgtcccccggctacgtcctcggcgtcttcctccgcaagctcacctcccgcgagaccgccctcatggtcatcggcatggccatgaccaccaccctctccatcccccacgacctcatggagctcatcgacggcatctccctcggcctcatcctcctcaagatcgtcacccagttcgacaacacccaggtcggcaccctcgccctctccctcaccttcatccgctccaccatgtccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccatcaccatgaccctctggtacatgtggcaggtcaagacccagcgctccggcgccctctgggacgtcccctcccccgccgccacccagaaggccgccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgccccaagtggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggccgcgcctaccagcacgccctcaacgagctccccgagtccctcgagaccctcatgctcgtcgccctcctcggcgccatgaccgccggcatcttcctcttcttcatgcagggcaagggcatgggcaagctctccatgggcctcatcaccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcttcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagcacgccgtctcccgcggctcctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgcaagcacggcggcaacctcgtccgctgccccctctcccgcaactccacccacgagatgtactgggtctccggcgcctccggcaacatcgtctcctccgtcaacaccacctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatggtcatgaccaccaccgccaactggctctgggccctcctcggcaagaagaagaacccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggagatcgacaagaaggacggcgacctcatgtacgccgacgacaccgccggctgggacacccgcatcaccgaggacgacctccagaacgaggagctcatcaccgagcagatggccccccaccacaagatcctcgccaaggccatcttcaagctcacctaccagaacaaggtcgtcaaggtcctccgccccaccccccgcggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctccgcgagtgcggcgtcgaccgcctcaagcgcatggccatctccggcgacgactgcgtcgtcaagcccctcgacgagcgcttcggcacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgatcgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgccatgaagcgctactccgccccctccgagtccgagggcgtcctctga

SEQ ID NO: 13093 - RNA, 9867 nt, synthetic construct
  misc_feature 1..9867: note = derived and/or modified CDS sequence (opt2) from DENV-4__FJ639736__SS-prME
  source 1..9867: mol_type = other RNA
tccaccatgaccctcctctgcctcatccccaccgccatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggccctcatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccgccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctcctccacccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggtccggccgcgagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgtctccgacctcaagtactcctggaagacctggggcaaggccaagatcttcacccccgaggcccgcaactccaccttcctcatcgacggccccgacacctccgagtgccccaacgagcgccgcgcctggaactccctcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagcgcgcctccctcatcgaggtcaagacctgcctctggcccaagacccacaccctctggtccaacggcgtcctcgagtcccagatgctcatccccaagtcctacgccggccccttctcccagcacaactaccgccagggctacgccacccagaccgtcggcccctggcacctcggcaagctcgagatcgacttcggcgagtgccccggcaccaccgtcaccatccaggaggactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcaccgccggccagggcacctccgagaccttctccatgggcctcctctgcctcaccctcttcgtcgaggagtgcctccgccgccgcgtcacccgcaagcacatgatcctcgccgtcgtcatcaccctctgcgccatcatcctcggcggcctcacctggatggacctcctccgcgccctcatcatgctcggcgacaccatgtccggccgcatcggcggccagacccacctcgccatcatggccgtcttcaagatgtcccccggctacgtcctcggcgtcttcctccgcaagctcacctcccgcgagaccgccctcatggtcatcggcatggccatgaccaccaccctctccatcccccacgacctcatggagctcatcgacggcatctccctcggcctcatcctcctcaagatcgtcacccagttcgacaacacccaggtcggcaccctcgccctctccctcaccttcatccgctccaccatgtccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccgtcaccatgaccctctggtacatgtggcaggtcaagacccagcgctccggcgccctctgggacgtcccctcccccgccgccacccagaaggccgccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgcccccgctggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcaccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagcacgccgtctcccgcggctcctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgcaagcacggcggcaacctcgtccgctgccccctctcccgcaactccacccacgagatgtactgggtctccggcgcctccggcaacatcgtctcctccgtcaacaccacctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatggtcatgaccaccaccgccaactggctctgggccctcctcggcaagaagaagaacccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggagatcgacaagaaggacggcgacctcatgtacgccgacgacaccgccggctgggacacccgcatcaccgaggacgacctccagaacgaggagctcatcaccgagcagatggccccccaccacaagatcctcgccaaggccatcttcaagctcacctaccagaacaaggtcgtcaaggtcctccgccccaccccccgcggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctccgcgagtgcggcgtcgaccgcctcaagcgcatggccatctccggcgacgactgcgtcgtcaagcccctcgacgagcgcttcggcacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgatcgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgtcatgaagcgctactccgccccctccgagtccgagggcgtcctctga

SEQ ID NO: 13094 - RNA, 9867 nt, synthetic construct
  misc_feature 1..9867: note = derived and/or modified CDS sequence (opt2) from DENV-4__FJ639737__SS-prME
  source 1..9867: mol_type = other RNA
tccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcatcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggccctcatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccgccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctcctccacccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggtccggccgcgagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgtctccgacctcaagtactcctggaagacctggggcaaggccaagatcttcacccccgaggcccgcaactccaccttcctcatcgacggccccgacacctccgagtgccccaacgagcgccgcgcctggaactccctcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagcgcgcctccctcatcgaggtcaagacctgcctctggcccaagacccacaccctctggtccaacggcgtcctcgagtcccagatgctcatccccaagtcctacgccggccccttctcccagcacaactaccgccagggctacgccacccagaccgtcggcccctggcacctcggcaagctcgagatcgacttcggcgagtgccccggcaccaccgtcaccatccaggaggactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcaccgccggccagggcacctccgagaccttctccatgggcctcctctgcctcaccctcttcgtcgaggagtgcctccgccgccgcgtcacccgcaagcacatgatcctcgccgtcgtcatcaccctctgcgccatcatcctcggcggcctcacctggatggacctcctccgcgccctcatcatgctcggcgacaccatgtccggccgcatcggcggccagacccacctcgccatcatggccgtcttcaagatgtcccccggctacgtcctcggcgtcttcctccgcaagctcacctcccgcgagaccgccctcatggtcatcggcatggccatgaccaccaccctctccatcccccacgacctcatggagctcatcgacggcatctccctcggcctcatcctcctcaagatcgtcacccagttcgacgacacccaggtcggcaccctcgccctctccctcaccttcatccgctccaccatgtccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgcctccgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccgtcaccatgaccctctggtacatgtggcaggtcaagacccagcgctccggcgccctctgggacgtcccctcccccgccgccacccagaaggccgccctctccgagggcgtctaccgcatcatgcagcgcggcctcttcggcaagacccaggtcggcgtcggcatccacatcgagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgcccccgctggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcaccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagcacgccgtctcccgcggctcctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccatcgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgcaagcacggcggcaacctcgtccgctgccccctctcccgcaactccacccacgagatgtactgggtctccggcgcctccggcaacatcgtctcctccgtcaacaccacctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatggtcatgaccaccaccgccaactggctctgggccctcctcggcaagaagaagaacccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggagatcgacaagaaggacggcgacctcatgtacgccgacgacaccgccggctgggacacccgcatcaccgaggacgacctccagaacgaggagctcatcaccgagcagatggccccccaccacaagatcctcgccaaggccatcttcaagctcacctaccagaacaaggtcgtcaaggtcctccgccccaccccccgcggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctccgcgagtgcggcgtcgaccgcctcaagcgcatggccatctccggcgacgactgcgtcgtcaagcccctcgacgagcgcttcggcacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgatcgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgtcatgaagcgctactccgccccctccgagtccgagggcgtcctctga

SEQ ID NO: 13095 - RNA, 9867 nt, synthetic construct
  misc_feature 1..9867: note = derived and/or modified CDS sequence (opt2) from DENV-4__FJ639738__SS-prME
  source 1..9867: mol_type = other RNA
tccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggccctcatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccgccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctcctccacccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggtccggccgcgagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgtctccgacctcaagtactcctggaagacctggggcaaggccaagatcttcacccccgaggcccgcaactccaccttcctcatcgacggccccgacacctccgagtgccccaacgagcgccgcgcctggaactccctcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagcgcgcctccctcatcgaggtcaagacctgcctctggcccaagacccacaccctctggtccaacggcgtcctcgagtcccagatgctcatccccaagtcctacgccggccccttctcccagcacaactaccgccagggctacgccacccagaccgtcggcccctggcacctcggcaagctcgagatcgacttcggcgagtgccccggcaccaccgtcaccatccaggaggactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcaccgccggccagggcacctccgagaccttctccatgggcctcctctgcctcaccctcttcgtcgaggagtgcctccgccgccgcgtcacccgcaagcacatgatcctcgccgtcgtcatcaccctctgcgccatcatcctcggcggcctcacctggatggacctcctccgcgccctcatcatgctcggcgacaccatgtccggccgcatcggcggccagacccacctcgccatcatggccgtcttcaagatgtcccccggctacgtcctcggcgtcttcctccgccgcctcacctcccgcgagaccgccctcatggtcatcggcatggccatgaccaccaccctctccatcccccacgacctcatggagctcatcgacggcatctccctcggcctcatcctcctcaagatcgtcacccagttcgacaacacccaggtcggcaccctcgccctctccctcaccttcatccgctccaccatgtccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccgtcaccatgaccctctggtacatgtggcaggtcaagacccagcgctccggcgccctctgggacgtcccctcccccgccgccacccagaaggccgccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccgtcgagcccggcaagaaccccaagcacgtccagaccaagcccggcctcttcaagaccatcaccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgcccccgctggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcaccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagcacgccgtctcccgcggctcctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgcaagcacggcggcaacctcgtccgctgccccctctcccgcaactccacccacgagatgtactgggtctccggcgcctccggcaacatcgtctcctccgtcaacaccacctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatggtcatgaccaccaccgccaactggctctgggccctcctcggcaagaagaagaacccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggagatcgacaagaaggacggcgacctcatgtacgccgacgacaccgccggctgggacacccgcatcaccgaggacgacctccagaacgaggagctcatcaccgagcagatggccccccaccacaagatcctcgccaaggccatcttcaagctcacctaccagaacaaggtcgtcaaggtcctccgccccaccccccgcggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctccgcgagtgcggcgtcgaccgcctcaagcgcatggccatctccggcgacgactgcgtcgtcaagcccctcgacgagcgcttcggcacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgatcgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgtcatgaagcgctactccgccccctccgagtccgagggcgtcctctga

SEQ ID NO: 13096 - RNA, 9867 nt, synthetic construct
  misc_feature 1..9867: note = derived and/or modified CDS sequence (opt2) from DENV-4__FJ639739__SS-prME
  source 1..9867: mol_type = other RNA
tccaccatgaccctcctctgcctcatccccaccgccatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggccctcatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccgccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctcctccacccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggtccggccgcgagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgtctccgacctcaagtactcctggaagacctggggcaaggccaagatcttcacccccgaggcccgcaactccaccttcctcatcgacggccccgacacctccgagtgccccaacgagcgccgcgcctggaactccctcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagcgcgcctccctcatcgaggtcaagacctgcctctggcccaagacccacaccctctggtccaacggcgtcctcgagtcccagatgctcatccccaagtcctacgccggccccttctcccagcacaactaccgccagggctacgccacccagaccgtcggcccctggcacctcggcaagctcgagatcgacttcggcgagtgccccggcaccaccgtcaccatccaggaggactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcaccgccggccagggcacctccgagaccttctccatgggcctcctctgcctcaccctcttcgtcgaggagtgcctccgccgccgcgtcacccgcaagcacatgatcctcgccgtcgtcatcaccctctgcgccatcatcctcggcggcctcacctggatggacctcctccgcgccctcatcatgctcggcgacaccatgtccggccgcatcggcggccagacccacctcgccatcatggccgtcttcaagatgtcccccggctacgtcctcggcgtcttcctccgcaagctcacctcccgcgagaccgccctcatggtcatcggcatggccatgaccaccaccctctccatcccccacgacctcatggagctcatcgacggcatctccctcggcctcatcctcctcaagatcgtcacccagttcgacaacacccaggtcggcaccctcgccctctccctcaccttcatccgctccaccatgtccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccgtcaccatgaccctctggtacatgtggcaggtcaagacccagcgctccggcgccctctgggacgtcccctcccccgccgccacccagaaggccgccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcgccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgcccccgctggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcaccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagcacgccgtctcccgcggctcctccaagatccgctggatcgtcgagcgcggcatggtcaagcccaagggcaagatcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgcaagcacggcggcaacctcgtccgctgccccctctcccgcaactccacccacgagatgtactgggtctccggcgcctccggcaacatcgtctcctccgtcaacaccacctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatggtcatgaccaccaccgccaactggctctgggccctcctcggcaagaagaagaacccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggagatcgacaagaaggacggcgacctcatgtacgccgacgacaccgccggctgggacacccgcatcaccgaggacgacctccagaacgaggagctcatcaccgagcagatggccccccaccacaagatcctcgccaaggccatcttcaagctcacctaccagaacaaggtcgtcaaggtcctccgccccaccccccgcggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctccgcgagtgcggcgtcgaccgcctcaagcgcatggccatctccggcgacgactgcgtcgtcaagcccctcgacgagcgcttcggcacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggctccccacctcccgcaccacctggtccatccacgcccaccaccagtggatgaccaccgaggacatgctcaaggtctggaaccgcgtctggatcgaggacaaccccaacatgatcgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgtcatgaagcgctactccgccccctccgagtccgagggcgtcctctga

SEQ ID NO: 13097 - RNA, 9867 nt, synthetic construct
  misc_feature 1..9867: note = derived and/or modified CDS sequence (opt2) from DENV-4__JN819409__SS-prME
  source 1..9867: mol_type = other RNA
tccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcaccgccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggccctcatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccgccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctcctccacccccctcgccgagaacaccaacggcgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggtccggccgcgagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgtctccgacctcaagtactcctggaagacctggggcaaggccaagatcttcacccccgaggcccgcaactccaccttcctcatcgacggccccgacacctccgagtgccccaacgagcgccgcgcctggaactccctcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagcgcgcctccctcatcgaggtcaagacctgcctctggcccaagacccacaccctctggtccaacggcgtcctcgagtcccagatgctcatccccaagtcctacgccggccccttctcccagcacaactaccgccagggctacgccacccagaccgtcggcccctggcacctcggcaagctcgagatcgacttcggcgagtgccccggcaccaccgtcaccatccaggaggactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcaccgccggccagggcacctccgagaccttctccatgggcctcctctgcctcaccctcttcgtcgaggagtgcctccgccgccgcgtcacccgcaagcacatgatcctcgccgtcatcatcaccctctgcgccatcatcctcggcggcctcacctggatggacctcctccgcgccctcatcatgctcggcgacaccatgtccggccgcatcggcggccagacccacctcgccatcatggccgtcttcaagatgtcccccggctacgtcctcggcgtcttcctccgcaagctcacctcccgcgagaccgccctcatggtcatcggcatggccatgaccaccaccctctccatcccccacgacctcatggagctcatcgacggcatctccctcggcctcatcctcctcaagatcgtcacccagttcgacaacacccaggtcggcaccctcgccctctccctcaccttcatccgctccaccatgtccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccgtcaccatgaccctctggtacatgtggcaggtcaagacccagcgctccggcgccctctgggacgtcccctcccccgccgccacccagaaggccgccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgcccccgctggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcaccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagcacgccgtctcccgcggctcctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgcaagcacggcggcaacctcgtccgctgccccctctcccgcaactccacccacgagatgtactgggtctccggcgcctccggcaacatcgtctcctccgtcaacaccacctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatggtcatgaccaccaccgccaactggctctgggccctcctcggcaagaagaagaacccccgcctctgcaccaaggaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggagatcgacaagaaggacggcgacctcatgtacgccgacgacaccgccggctgggacacccgcatcaccgaggacgacctccagaacgaggagctcatcaccgagcagatggccccccaccacaagatcctcgccaaggccatcttcaagctcacctaccagaacaaggtcgtcaaggtcctccgccccaccccccgcggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctccgcgagtgcggcgtcgaccgcctcaagcgcatggccatctccggcgacgactgcgtcgtcaagcccctcgacgagcgcttcggcacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgaccgacaagacccccatccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgtcatgaagcgctactccgccccctccgagtccgagggcgtcctctga

SEQ ID NO: 13098 - RNA, 9867 nt, synthetic construct
  misc_feature 1..9867: note = derived and/or modified CDS sequence (opt2) from DENV-4__FJ639742__SS-prME
  source 1..9867: mol_type = other RNA
tccaccatgaccctcctctgcctcatccccaccgccatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatggtcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggccctcatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccgccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctcctccacccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggtccggccgcgagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgtctccgacctcaagtactcctggaagacctggggcaaggccaagatcttcacccccgaggcccgcaactccaccttcctcatcgacggccccgacacctccgagtgccccaacgagcgccgcgcctggaactccctcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagcgcgcctccctcatcgaggtcaagacctgcctctggcccaagacccacaccctctggtccaacggcgtcctcgagtcccagatgctcatccccaagtcctacgccggccccttctcccagcacaactaccgccagggctacgccacccagaccgtcggcccctggcacctcggcaagctcgagatcgacttcggcgagtgccccggcaccaccgtcaccatccaggaggactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcaccgccggccagggcacctccgagaccttctccatgggcctcctctgcctcaccctcttcgtcgaggagtgcctccgccgccgcgtcacccgcaagcacatgatcctcgccgtcgtcatcaccctctgcgccatcatcctcggcggcctcacctggatggacctcctccgcgccctcatcatgctcggcgacaccatgtccggccgcatcggcggccagacccacctcgccatcatggccgtcttcaagatgtcccccggctacgtcctcggcgtcttcctccgcaagctcacctcccgcgagaccgccctcatggtcatcggcatggccatgaccaccaccctctccatcccccacgacctcatggagctcatcgacggcatctccctcggcctcatcctcctcaagatcgtcacccagttcgacaacacccaggtcggcaccctcgccctctccctcaccttcatccgctccaccatgtccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgcctccgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccgtcaccatgaccctctggtacatgtggcaggtcaagacccagcgctccggcgccctctgggacgtcccctcccccgccgccacccagaaggccgccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgcccccgctggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcaccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagcacgccgtctcccgcggctcctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgcaagcacggcggcaacctcgtccgctgccccctctcccgcaactccacccacgagatgtactgggtctccggcgcctccggcaacatcgtctcctccgtcaacaccacctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatggtcatgaccaccaccgccaactggctctgggccctcctcggcaagaagaagaacccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggagatcgacaagaaggacggcgacctcatgtacgccgacgacaccgccggctgggacacccgcatcaccgaggacgacctccagaacgaggagctcatcaccgagcagatggccccccaccacaagatcctcgccaaggccatcttcaagctcacctaccagaacaaggtcgtcaaggtcctccgccccaccccccgcggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctccgcgagtgcggcgtcgaccgcctcaagcgcatggccatctccggcgacgactgcgtcgtcaagcccctcgacgagcgcttcggcacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgatcgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgtcatgaagcgctactccgccccctccgagtccgagggcgtcctctga

SEQ ID NO: 13099 - RNA, 9867 nt, synthetic construct
  misc_feature 1..9867: note = derived and/or modified CDS sequence (opt2) from DENV-4__FJ639745__SS-prME
  source 1..9867: mol_type = other RNA
tccaccatgaccctcctctgcctcatccccaccgccatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggccctcatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccgccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctcctccacccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcctcctcgtcctctggatcggcaccaactcccgcaacacctccatggccatgacctgcatcgccgtcggcggcatcaccctcttcctcggcttcaccgtccaggccgacatgggctgcgtcgtctcctggtccggccgcgagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgtctccgacctcaagtactcctggaagacctggggcaaggccaagatcttcacccccgaggcccgcaactccaccttcctcatcgacggccccgacacctccgagtgccccaacgagcgccgcgcctggaactccctcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagcgcgcctccctcatcgaggtcaagacctgcctctggcccaagacccacaccctctggtccaacggcgtcctcgagtcccagatgctcatccccaagtcctacgccggccccttctcccagcacaactaccgccagggctacgccacccagaccgtcggcccctggcacctcggcaagctcgagatcgacttcggcgagtgccccggcaccaccgtcaccatccaggaggactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcaccgccggccagggcacctccgagaccttctccatgggcctcctctgcctcaccctcttcgtcgaggagtgcctccgccgccgcgtcacccgcaagcacatgatcctcgccgtcgtcatcaccctctgcgccatcatcctcggcggcctcacctggatggacctcctccgcgccctcatcatgctcggcgacaccatgtccggccgcatcggcggccagacccacctcgccatcatggccgtcttcaagatgtcccccggctacgtcctcggcgtcttcctccgcaagctcacctcccgcgagaccgccctcatggtcatcggcatggccatgaccaccaccctctccatcccccacgacctcatggagctcatcgacggcatctccctcggcctcatcctcctcaagatcgtcacccagttcgacaacacccaggtcggcaccctcgccctctccctcaccttcatccgctccaccatgtccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccgtcaccatgaccctctggtacatgtggcaggtcaagacccagcgctccggcgccctctgggacgtcccctcccccgccgccacccagaaggccgccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgcccccgctggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcaccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagcacgccgtctcccgcggctcctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgcaagcacggcggcaacctcgtccgctgccccctctcccgcaactccacccacgagatgtactgggtctccggcgcctccggcaacatcgtctcctccgtcaacaccacctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatggtcatgaccaccaccgccaactggctctgggccctcctcggcaagaagaagaacccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggagatcgacaagaaggacggcgacctcatgtacgccgacgacaccgccggctgggacacccgcatcaccgaggacgacctccagaacgaggagctcatcaccgagcagatggccccccaccacaagatcctcgccaaggccatcttcaagctcacctaccagaacaaggtcgtcaaggtcctccgccccaccccccgcggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctccgcgagtgcggcgtcgaccgcctcaagcgcatggccatctccggcgacgactgcgtcgtcaagcccctcgacgagcgcttcgccacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgatcgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgtcatgaagcgctactccgccccctccgagtccgagggcgtcctctga

SEQ ID NO: 13100 - RNA, 9867 nt, synthetic construct
  misc_feature 1..9867: note = derived and/or modified CDS sequence (opt2) from DENV-4__FJ850095__SS-prME
  source 1..9867: mol_type = other RNA
tccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggccctcatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccaccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctccgccacccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggtccggccgcgagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgcctccgacctcaagtactcctggaagacctggggcaaggccaagatcttcacccccgaggcccgcaactccaccttcctcatcgacggccccgacacctccgagtgccccaacgagcgccgcgcctggaactccttcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagcgcgcctccctcatcgaggtcaagacctgcctctggcccaagacccacaccctctggtccaacggcgtcctcgagtcccagatgctcatccccaagtcctacgccggccccttctcccagcacaactaccgccagggctacgccacccagaccgtcggcccctggcacctcggcaagctcgagatcgacttcggcgagtgccccggcaccaccgtcaccatccaggaggactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcaccgccggccagggcacctccgagaccttctccatgggcctcctctgcctcaccctcttcgtcgaggagtgcctccgccgccgcgtcacccgcaagcacatgatcctcgccgtcgtcatcaccctctgcgccatcatcctcggcggcctcacctggatggacctcctccgcgccctcatcatgctcggcgacaccatgtccggccgcatcggcggccagacccacctcgccatcatggccgtcttcaagatgtcccccggctacgtcctcggcgtcttcctccgcaagctcacctcccgcgagaccgccctcatggtcatcggcatggccatgaccaccaccctctccatcccccacgacctcatggagctcatcgacggcatctccctcggcctcatcctcctcaagatcgtcacccagttcgacaacacccaggtcggcaccctcgccctctccctcaccttcatccgctccaccatgtccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccgtcaccatgaccctctggtacatgtggcaggtcaagacccagcgctccggcgccctctgggacgtcccctcccccgccgccacccagaaggccgccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgccccaagtggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcaccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagcacgccgtctcccgcggctcctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgcaagcacggcggcaacctcgtccgctgccccctctcccgcaactccacccacgagatgtactgggtctccggcgcctccggcaacatcgtctcctccgtcaacaccacctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatggtcatgaccaccaccgccaactggctctgggccctcctcggcaagaagaagaacccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggagatcgacaagaaggacggcgacctcatgtacgccgacgacaccgccggctgggacacccgcatcaccgaggacgacctccagaacgaggagctcatcaccgagcagatggccccccaccacaagatcctcgccaaggccatcttcaagctcacctaccagaacaaggtcgtcaaggtcctccgccccaccccccgcggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctccgcgagtgcggcgtcgaccgcctcaagcgcatggccatctccggcgacgactgcgtcgtcaagcccctcgacgagcgcttcggcacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgatcgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgtcatgaagcgctactccgccccctccgagtccgagggcgtcctctga

SEQ ID NO: 13101 - RNA, 9867 nt, synthetic construct
  misc_feature 1..9867: note = derived and/or modified CDS sequence (opt2) from DENV-4__FJ639748__SS-prME
  source 1..9867: mol_type = other RNA
tccaccatgaccctcctctgcctcatccccaccgccatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggccctcatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtccagctccccgactacggcgagctcaccctcgactgcgagccccgctccggcatcgacttcaacgagatgatcctcatgaagatgaagaagaagacctggctcgtccacaagcagtggttcctcgacctccccctcccctggaccgccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctcctccacccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcctcctcgtcctctggatcggcaccaactcccgcaacacctccatggccatgacctgcatcgccgtcggcggcatcaccctcttcctcggcttcaccgtccaggccgacgtcggctgcgtcgtctcctggtccggccgcgagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgtctccgacctcaagtactcctggaagacctggggcaaggccaagatcttcacccccgaggcccgcaactccaccttcctcatcgacggccccgacacctccgagtgccccaacgagcgccgcgcctggaactccctcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagcgcgcctccctcatcgaggtcaagacctgcctctggcccaagacccacaccctctggtccaacggcgtcctcgagtcccagatgctcatccccaagtcctacgccggccccttctcccagcacaactaccgccagggctacgccacccagaccgtcggcccctggcacctcggcaagctcgagatcgacttcggcgagtgccccggcaccaccgtcaccatccaggaggactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcaccgccggccagggcacctccgagaccttctccatgggcctcctctgcctcaccctcttcgtcgaggagtgcctccgccgccgcgtcacccgcaagcacatgatcctcgccgtcgtcatcaccctctgcgccatcatcctcggcggcctcacctggatggacctcctccgcgccctcatcatgctcggcgacaccatgtccggccgcatcggcggccagacccacctcgccatcatggccgtcttcaagatgtcccccggctacgtcctcggcgtcttcctccgcaagctcacctcccgcgagaccgccctcatggtcatcggcatggccatgaccaccaccctctccatcccccacgacctcatggagctcatcgacggcatctccctcggcctcatcctcctcaagatcgtcacccagttcgacaacacccaggtcggcaccctcgccctctccctcaccttcatccgctccaccatgtccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccgtcaccatgaccctctggtacatgtggcaggtcaagacccagcgctccggcgccctctgggacgtcccctcccccgccgccacccagaaggccgccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgcccccgctggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcaccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagcacgccgtctcccgcggctcctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgcaagcacggcggcaacctcgtccgctgccccctctcccgcaactccacccacgagatgtactgggtctccggcgcctccggcaacatcgtctcctccgtcaacaccacctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagtccaagcccggcacccgcatggtcatgaccaccaccgccaactggctctgggccctcctcggcaagaagaagaacccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggagatcgacaagaaggacggcgacctcatgtacgccgacgacaccgccggctgggacacccgcatcaccgaggacgacctccagaacgaggagctcatcaccgagcagatggccccccaccacaagatcctcgccaaggccatcttcaagctcacctaccagaacaaggtcgtcaaggtcctccgccccaccccccgcggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctccgcgagtgcggcgtcgaccgcctcaagcgcatggccatctccggcgacgactgcgtcgtcaagcccctcgacgagcgcttcgccacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgatcgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgtcatgaagcgctactccgccccctccgagaacgagggcgtcctctga

SEQ ID NO: 13102 - RNA, 9867 nt, synthetic construct
  misc_feature 1..9867: note = derived and/or modified CDS sequence (opt2) from DENV-4__FJ639764__SS-prME
  source 1..9867: mol_type = other RNA
tccaccatcaccctcctctgcctcatccccaccgtcatggccttccacctctccacccgcgacggcgagcccctcatgatcgtcgccaagcacgagcgcggccgccccctcctcttcaagaccaccgagggcaccaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggccctcatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccgccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctcctccacccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggtccggccgcgagctcaagtgcggctccggcatcttcgtcgtcgacaacgtccacacctggatcgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcaccctcaccccccccgtctccgacctcaagtactcctggaagacctggggcaaggccaagatcttcacccccgaggcccgcaactccaccttcctcatcgacggccccgacacctccgagtgccccaacgagcgccgcgcctggaactccctcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagcgcgcctccctcatcgaggtcaagacctgcctctggcccaagacccacaccctctggtccaacggcgtcctcgagtcccagatgctcatccccaagtcctacgccggccccttctcccagcacaactaccgccagggctacgccacccagaccgtcggcccctggcacctcggcaagctcgagatcgacttcggcgagtgccccggcaccaccgtcaccatccaggaggactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcaccgccggccagggcacctccgagaccttctccatgggcctcctctgcctcaccctcttcgtcgaggagtgcctccgccgccgcgtcacccgcaagcacatgatcctcgccgtcgtcatcaccctctgcgccatcatcctcggcggcctcacctggatggacctcctccgcgccctcatcatgctcggcgacaccatgtccggccgcatcggcggccagacccacctcgccatcatggccgtcttcaagatgtcccccggctacgtcctcggcgtcttcctccgccgcctcacctcccgcgagaccgccctcatggtcatcggcatggccatgaccaccaccctctccatcccccacgacctcatggagctcatcgacggcatctccctcggcctcatcctcctcaagatcgtcacccagttcgacaacacccaggtcggcaccctcgccctctccctcaccttcatccgctccaccatgtccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccgtcaccatgaccctctggtacatgtggcaggtcaagacccagcgctccggcgccctctgggacgtcccctcccccgccgccacccagaaggccgccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccgtcgagcccggcaagaaccccaagcacgtccagaccaagcccggcctcttcaagaccatcaccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgcccccgctggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcaccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagcacgccgtctcccgcggctcctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgcaagcacggcggcaacctcgtccgctgccccctctcccgcaactccacccacgagatgtactgggtctccggcgcctccggcaacatcgtctcctccgtcaacaccacctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatggtcatgaccaccaccgccaactggctctgggccctcctcggcaagaagaagaacccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggagatcgacaagaaggacggcgacctcatgtacgccgacgacaccgccggctgggacacccgcatcaccgaggacgacctccagaacgaggagctcatcaccgagcagatggccccccaccacaagatcctcgccaaggccatcttcaagctcacctaccagaacaaggtcgtcaaggtcctccgccccaccccccgcggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctccgcgagtgcggcgtcgaccgcctcaagcgcatggccatctccggcgacgactgcgtcgtcaagcccctcgacgagcgcttcggcacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgatcgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgtcatgaagcgctactccgccccctccgagtccgagggcgtcctctga

SEQ ID NO: 13103 - RNA, 9867 nt, synthetic construct
  misc_feature 1..9867: note = derived and/or modified CDS sequence (opt2) from DENV-4__FJ639773__SS-prME
  source 1..9867: mol_type = other RNA
tccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggccctcatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccaccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagcgcctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctccgccacccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggtccggccgcgagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgcctccgacctcaagtactcctggaagacctggggcaaggccaagatcttcacccccgaggcccgcaactccaccttcctcatcgacggccccgacacctccgagtgccccaacgagcgccgcgcctggaactccttcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagcgcgcctccctcatcgaggtcaagacctgcctctggcccaagacccacaccctctggtccaacggcgtcctcgagtcccagatgctcatccccaagtcctacgccggccccttctcccagcacaactaccgccagggctacgccacccagaccgtcggcccctggcacctcggcaagctcgagatcgacttcggcgagtgccccggcaccaccgtcaccatccaggaggactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcaccgccggccagggcacctccgagaccttctccatgggcctcctctgcctcaccctcttcgtcgaggagtgcctccgccgccgcgtcacccgcaagcacatgatcctcgccgtcgtcatcaccctctgcgccatcatcctcggcggcctcacctggatggacctcctccgcgccctcatcatgctcggcgacaccatgtccggccgcatcggcggccagacccacctcgccatcatggccgtcttcaagatgtcccccggctacgtcctcggcgtcttcctccgcaagctcacctcccgcgagaccgccctcatggtcatcggcatggccatgaccaccaccctctccatcccccacgacctcatggagctcatcgacggcatctccctcggcctcatcctcctcaagatcgtcacccagttcgacaacacccaggtcggcaccctcgccctctccctcaccttcatccgctccaccatgtccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccgtcaccatgaccctctggtacatgtggcaggtcaagacccagcgctccggcgccctctgggacgtcccctcccccgccaccacccagaaggccgccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgccccaagtggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcaccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggagaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagcacgccgtctcccgcggctcctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgcaagcacggcggcaacctcgtccgctgccccctctcccgcaactccacccacgagatgtactgggtctccggcgcctccggcaacatcgtctcctccgtcaacaccacctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatggtcatgaccaccaccgccaactggctctgggccctcctcggcaagaagaagaacccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggagatcgacaagaaggacggcgacctcatgtacgccgacgacaccgccggctgggacacccgcatcaccgaggacgacctccagaacgaggagctcatcaccgagcagatggccccccaccacaagatcctcgccaaggccatcttcaagctcacctaccagaacaaggtcgtcaaggtcctccgccccaccccccgcggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctccgcgagtgcggcgtcgaccgcctcaagcgcatggccatctccggcgacgactgcgtcgtcaagcccctcgacgagcgcttcggcacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgatcgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgtcatgaagcgctactccgccccctccgagtccgagggcgtcctctga

SEQ ID NO: 13104 - RNA, 9867 nt, synthetic construct
  misc_feature 1..9867: note = derived and/or modified CDS sequence (opt2) from DENV-4__FJ882580__SS-prME
  source 1..9867: mol_type = other RNA
tccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggccctcatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccaccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagcgcgtcgtcggccgcgtcatctccgccacccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggtccggccgcgagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccatcgtcgccggcgacgtcaagggcgtcctcaccaagggcaagcgcgccctcaccccccccgcctccgacctcaagtactcctggaagacctggggcaaggccaagatcttcacccccgaggcccgcaactccaccttcctcatcgacggccccgacacctccgagtgccccaacgagcgccgcgcctggaactccttcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagcgcgcctccctcatcgaggtcaagacctgcctctggcccaagacccacaccctctggtccaacggcgtcctcgagtcccagatgctcatccccaagtcctacgccggccccttctcccagcacaactaccgccagggctacgccacccagaccgtcggcccctggcacctcggcaagctcgagatcgacttcggcgagtgccccggcaccaccgtcaccatccaggagaactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcaccgccggccagggcacctccgagaccttctccatgggcctcctctgcctcaccctcttcgtcgaggagtgcctccgccgccgcgtcacccgcaagcacatgatcctcgccgtcgtcatcaccctctgcgccatcatcctcggcggcctcacctggatggacctcctccgcgccctcatcatgctcggcgacaccatgtccggccgcatcggcggccagacccacctcgccatcatggccgtcttcaagatgtcccccggctacgtcctcggcgtcttcctccgcaagctcacctcccgcgagaccgccctcatggtcatcggcatggccatgaccaccaccctctccatcccccacgacctcatggagctcatcgacggcatctccctcggcctcatcctcctcaagatcgtcacccagttcgacaacacccaggtcggcaccctcgccctctccctcaccttcatccgctccaccatgtccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccatcaccatgaccctctggtacatgtggcaggtcaagacccagcgctccggcgccctctgggacgtcccctcccccgccgccacccagaaggccgccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgccccaagtggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcaccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagcacgccgtctcccgcggctcctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgcaagcacggcggcaacctcgtccgctgccccctctcccgcaactccacccacgagatgtactgggtctccggcgcctccggcaacatcgtctcctccgtcaacaccacctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatggtcatgaccaccaccgccaactggctctgggccctcctcggcaagaagaagaacccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggagatcgacaagaaggacggcgacctcatgtacgccgacgacaccgccggctgggacacccgcatcaccgaggacgacctccagaacgaggagctcatcaccgagcagatggccccccaccacaagatcctcgccaaggccatcttcaagctcacctaccagaacaaggtcgtcaaggtcctccgccccaccccccgcggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctccgcgagtgcggcgtcgaccgcctcaagcgcatggccatctccggcgacgactgcgtcgtcaagcccctcgacgagcgcttcggcacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgatcgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgtcatgaagcgctactccgccccctccgagtccgagggcgtcctctga

SEQ ID NO: 13105 - RNA, 9867 nt, synthetic construct
  misc_feature 1..9867: note = derived and/or modified CDS sequence (opt2) from DENV-4__FJ882581__SS-prME
  source 1..9867: mol_type = other RNA
tccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggccctcatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccaccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctccgccacccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggaacggccgcgagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgcctccgacctcaagtactcctggaagacctggggcaaggccaagatcttcacccccgaggcccgcaactccaccttcctcatcgacggccccgacacctccgagtgccccaacgagcgccgcgcctggaactccttcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagcgcgcctccctcatcgaggtcaagacctgcctctggcccaagacccacaccctctggtccaacggcgtcctcgagtcccagatgctcatccccaagtcctacgccggccccttctcccagcacaactaccgccagggctacgccacccagaccgtcggcccctggcacctcggcaagctcgagatcgacttcggcgagtgccccggcaccaccgtcaccatccaggagaactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcaccgccggccagggcacctccgagaccttctccatgggcctcctctgcctcaccctcttcgtcgaggagtgcctccgccgccgcgtcacccgcaagcacatgatcctcgccgtcgtcatcaccctctgcgccatcatcctcggcggcctcacctggatggacctcctccgcgccctcatcatgctcggcgacaccatgtccggccgcatcggcggccagacccacctcgccatcatggccgtcttcaagatgtcccccggctacgtcctcggcgtcttcctccgcaagctcacctcccgcgagaccgccctcatggtcatcggcatggccatgaccaccaccctctccatcccccacgacctcatggagctcatcgacggcatctccctcggcctcatcctcctcaagatcgtcacccagttcgacaacacccaggtcggcaccctcgccctctccctcaccttcatccgctccaccatgtccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccatcaccatgaccctctggtacatgtggcaggtcaagacccagcgctccggcgccctctgggacgtcccctcccccgccgccacccagaaggccgccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaacctcgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgccccaagtggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcaccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagcacgccgtctcccgcggctcctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgcaagcacggcggcaacctcgtccgctgccccctctcccgcaactccacccacgagatgtactgggtctccggcgcctccggcaacatcgtctcctccgtcaacaccacctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatggtcatgaccaccaccgccaactggctctgggccctcctcggcaagaagaagaacccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggagatcgacaagaaggacggcgacctcatgtacgccgacgacaccgccggctgggacacccgcatcaccgaggacgacctccagaacgaggagctcatcaccgagcagatggccccccaccacaagatcctcgccaaggccatcttcaagctcacctaccagaacaaggtcgtcaaggtcctccgccccaccccccgcggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctccgcgagtgcggcgtcgaccgcctcaagcgcatggccatctccggcgacgactgcgtcgtcaagcccctcgacgagcgcttcggcacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgatcgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgtcatgaagcgctactccgccccctccgagtccgagggcgtcctctga

SEQ ID NO: 13106 - RNA, 9867 nt, synthetic construct
  misc_feature 1..9867: note = derived and/or modified CDS sequence (opt2) from DENV-4__FJ882582__SS-prME
  source 1..9867: mol_type = other RNA
tccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggccctcatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccaccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctccgccacccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggaacggccgcgagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgcctccgacctcaagtactcctggaagacctggggcaaggccaagatcttcacccccgaggcccgcaactccaccttcctcatcgacggccccgacacctccgagtgccccaacgagcgccgcgcctggaactccttcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagcgcgcctccctcatcgaggtcaagacctgcctctggcccaagacccacaccctctggtccaacggcgtcctcgagtcccagatgctcatccccaagtcctacgccggccccttctcccagcacaactaccgccagggctacgccacccagaccgtcggcccctggcacctcggcaagctcgagatcgacttcggcgagtgccccggcaccaccgtcaccatccaggagaactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcaccgccggccagggcacctccgagaccttctccatgggcctcctctgcctcaccctcttcgtcgaggagtgcctccgccgccgcgtcacccgcaagcacatgatcctcgccgtcgtcatcaccctctgcgccatcatcctcggcggcctcacctggatggacctcctccgcgccctcatcatgctcggcgacaccatgtccggccgcatcggcggccagacccacctcgccatcatggccgtcttcaagatgtcccccggctacgtcctcggcgtcttcctccgcaagctcacctcccgcgagaccgccctcatggtcatcggcatggccatgaccaccaccctctccatcccccacgacctcatggagctcatcgacggcatctccctcggcctcatcctcctcaagatcgtcacccagttcgacaacacccaggtcggcaccctcgccctctccctcaccttcatccgctccaccatgtccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccatcaccatgaccctctggtacatgtggcaggtcaagacccagcgctccggcgccctctgggacgtcccctcccccgccgccacccagaaggccgccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaacctcgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgccccaagtggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcaccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagcacgccgtctcccgcggctcctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgcaagcacggcggcaacctcgtccgctgccccctctcccgcaactccacccacgagatgtactgggtctccggcgcctccggcaacatcgtctcctccgtcaacaccacctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatggtcatgaccaccaccgccaactggctctgggccctcctcggcaagaagaagaacccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggagatcgacaagaaggacggcgacctcatgtacgccgacgacaccgccggctgggacacccgcatcaccgaggacgacctccagaacgaggagctcatcaccgagcagatggccccccaccacaagatcctcgccaaggccatcttcaagctcacctaccagaacaaggtcgtcaaggtcctccgccccaccccccgcggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctccgcgagtgcggcgtcgaccgcctcaagcgcatggccatctccggcgacgactgcgtcgtcaagcccctcgacgagcgcttcggcacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgatcgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgccgactacatgcccgtcatgaagcgctactccgccccctccgagtccgagggcgtcctctga

SEQ ID NO: 13107 - RNA, 9867 nt, synthetic construct
  misc_feature 1..9867: note = derived and/or modified CDS sequence (opt2) from DENV-4__FJ882584__SS-prME
  source 1..9867: mol_type = other RNA
tccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggcctccatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccaccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctccgccacccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggtccggccgcgagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgcctccgacctcaagtactcctggaagacctggggcaaggccaagatcttcacccccgaggcccgcaactccaccttcctcatcgacggccccgacacctccgagtgccccaacgagcgccgcgcctggaactccttcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagcgcgcctccctcatcgaggtcaagacctgcctctggcccaagacccacaccctctggtccaacggcgtcctcgagtcccagatgctcatccccaagtcctacgccggccccttctcccagcacaactaccgccagggctacgccacccagaccgtcggcccctggcacctcggcaagctcgagatcgacttcggcgagtgccccggcaccaccgtcaccatccaggagaactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcaccgccggccagggcacctccgagaccttctccatgggcctcctctgcctcaccctcttcgtcgaggagtgcctccgccgccgcgtcacccgcaagcacatgatcctcgccgtcgtcatcaccctctgcgccatcatcctcggcggcctcacctggatggacctcctccgcgccctcatcatgctcggcgacaccatgtccggccgcatcggcggccagacccacctcgccatcatggccgtcttcaagatgtcccccggctacgtcctcggcgtcttcctccgcaagctcacctcccgcgagaccgccctcatggtcatcggcatggccatgaccaccaccctctccatcccccacgacctcatggagctcatcgacggcatctccctcggcctcatcctcctcaagatcgtcacccagttcgacaacacccaggtcggcaccctcgccctctccctcaccttcatccgctccaccatgtccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccatcaccatgaccctctggtacatgtggcaggtcaagacccagcgctccggcgccctctgggacgtcccctcccccgccgccacccagaaggccgccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgccccaagtggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcaccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagcacgccgtctcccgcggctcctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgcaagcacggcggcaacctcgtccgctgccccctctcccgcaactccacccacgagatgtactgggtctccggcgcctccggcaacatcgtctcctccgtcaacaccacctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatggtcatgaccaccaccgccaactggctctgggccctcctcggcaagaagaagaacccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggagatcgacaagaaggacggcgacctcatgtacgccgacgacaccgccggctgggacacccgcatcaccgaggacgacctccagaacgaggagctcatcaccgagcagatggccccccaccacaagatcctcgccaaggccatcttcaagctcacctaccagaacaaggtcgtcaaggtcctccgccccaccccccgcggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctccgcgagtgcggcgtcgaccgcctcaagcgcatggccatctccggcgacgactgcgtcgtcaagcccctcgacgagcgcttcggcacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgatcgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgtcatgaagcgctactccgccccctccgagtccgagggcgtcctctga

SEQ ID NO: 13108 - RNA, 9867 nt, synthetic construct
  misc_feature 1..9867: note = derived and/or modified CDS sequence (opt2) from DENV-4__FJ882585__SS-prME
  source 1..9867: mol_type = other RNA
tccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggccctcatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccaccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctccgccacccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggtccggccgcgagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgcctccgacctcaagtactcctggaagacctggggcaaggccaagatcttcacccccgaggcccgcaactccaccttcctcatcgacggccccgacacctccgagtgccccaacgagcgccgcgcctggaactccttcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagcgcgcctccctcatcgaggtcaagacctgcctctggcccaagacccacaccctctggtccaacggcgtcctcgagtcccagatgctcatccccaagtcctacgccggccccttctcccagcacaactaccgccagggctacgccacccagaccgtcggcccctggcacctcggcaagctcgagatcgacttcggcgagtgccccggcaccaccgtcaccatccaggagaactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcaccgccggccagggcacctccgagaccttctccatgggcctcctctgcctcaccctcttcgtcgaggagtgcctccgccgccgcgtcacccgcaagcacatgatcctcgccgtcgtcatcaccctctgcgccaccatcctcggcggcctcacctggatggacctcctccgcgccctcatcatgctcggcgacaccatgtccggccgcatcggcggccagacccacctcgccatcatggccgtcttcaagatgtcccccggctacgtcctcggcgtcttcctccgcaagctcacctcccgcgagaccgccctcatggtcatcggcatggccatgaccaccaccctctccatcccccacgacctcatggagctcatcgacggcatctccctcggcctcatcctcctcaagatcgtcacccagttcgacaacacccaggtcggcaccctcgccctctccctcaccttcatccgctccaccatgtccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgccatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccatcaccatgaccctctggtacatgtggcaggtcaagacccagcgctccggcgccctctgggacgtcccctcccccgccgccacccagaaggccgccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgccccaagtggctcgacgcccgcgtctacgccgaccccatggccctcaaggacttcaaggagttcgcctccggccgcaagtccaccaccctcgacatcctcaccgagatcgcctccctccccacctacctctcctcccgcgccaagctcgccctcgacaacatcgtcatgctccacaccaccgagcgcggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcaccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagcacgccgtctcccgcggctcctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgcaagcacggcggcaacctcgtccgctgccccctctcccgcaactccacccacgagatgtactgggtctccggcgcctccggcaacatcgtctcctccgtcaacaccacctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatggtcatgaccaccaccgccaactggctctgggccctcctcggcaagaagaagaacccccgcctctgcaccaaggaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggagatcgacaagaaggacggcgacctcatgtacgccgacgacaccgccggctgggacacccgcatcaccgaggacgacctccagaacgaggagctcatcaccgagcagatggccccccaccacaagatcctcgccaaggccatcttcaagctcacctaccagaacaaggtcgtcaaggtcctccgccccaccccccgcggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctccgcgagtgcggcgtcgaccgcctcaagcgcatggccatctccggcgacgactgcgtcgtcaagcccctcgacgagcgcttcggcacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgaccgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgtcatgaagcgctactccgccccctccgagtccgagggcgtcctctga

SEQ ID NO: 13109 - RNA, 9867 nt, synthetic construct
  misc_feature 1..9867: note = derived and/or modified CDS sequence (opt2) from DENV-4__FJ882586__SS-prME
  source 1..9867: mol_type = other RNA
tccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggccctcatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccaccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctccgccacccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggtccggccgcgagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgcctccgacctcaagtactcctggaagacctggggcaaggccaagatcttcacccccgaggcccgcaactccaccttcctcatcgacggccccgacacctccgagtgccccaacgagcgccgcgcctggaactccttcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagcgcgcctccctcatcgaggtcaagacctgcctctggcccaagacccacaccctctggtccaacggcgtcctcgagtcccagatgctcatccccaagtcctacgccggccccttctcccagcacaactaccgccagggctacgccacccagaccgtcggcccctggcacctcggcaagctcgagatcgacttcggcgagtgccccggcaccaccgtcaccatccaggagaactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcaccgccggccagggcacctccgagaccttctccatgggcctcctctgcctcaccctcttcgtcgaggagtgcctccgccgccgcgtcacccgcaagcacatgatcctcgccgtcgtcatcaccctctgcgccatcatcctcggcggcctcacctggatggacctcctccgcgccctcatcatgctcggcgacaccatgtccggccgcatcggcggccagacccacctcgccatcatggccgtcttcaagatgtcccccggctacgtcctcggcgtcttcctccgcaagctcacctcccgcgagaccgccctcatggtcatcggcatggccatgaccaccaccctctccatcccccacgacctcatggagctcatcgacggcatctccctcggcctcatcctcctcaagatcgtcacccagttcgacaacacccaggtcggcaccctcgccctctccctcaccttcatccgctccaccatgtccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccatcaccatgaccctctggtacatgtggcaggtcaagacccagcgctccggcgccctctgggacgtcccctcccccgccgccacccagaaggccgccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgccccaagtggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcaccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagcacgccgtctcccgcggctcctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgcaagcacggcggcaacctcgtccgctgccccctctcccgcaactccacccacgagatgtactgggtctccggcgcctccggcaacatcgtctcctccgtcaacaccacctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatggtcatgaccaccaccgccaactggctctgggccctcctcggcaagaagaagaacccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggagatcgacaagaaggacggcgacctcatgtacgccgacgacaccgccggctgggacacccgcatcaccgaggacgacctccagaacgaggagctcatcaccgagcagatggccccccaccacaagatcctcgccaaggccatcttcaagctcacctaccagaacaaggtcgtcaaggtcctccgccccaccccccgcggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctccgcgagtgcggcgtcgaccgcctcaagcgcatggccatctccggcgacgactgcgtcgtcaagcccctcgacgagcgcttcggcacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgatcgacaagacccccgtccactcctgggaggacatcccctacctcggcaagcgcgaggacctctggtgcggctccctcatcggcctctcctcccgcgccacctgggccaagaacatccacaccgccatcgcccaggtccgcaacctcatcggcaaggaggagtacgtcgactacatgcccgtcatgaagcgctactccgccccctccgagtccgagggcgtcctctga

SEQ ID NO: 13110 - RNA, 9867 nt, synthetic construct
  misc_feature 1..9867: note = derived and/or modified CDS sequence (opt2) from DENV-4__JN819406__SS-prME
  source 1..9867: mol_type = other RNA
tccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggccctcatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccaccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctccgccacccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggtccgcccgcgagctcaagtgcggctccggcatcttcgtcgtcgacaacgtccacacctggaccgagcagtaccagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgcctccgacctcaagtactcctggaagacctggggcaaggccaagatcttcacccccgaggcccgcaactccaccttcctcatcgacggccccgacacctccgagtgccccaacgagcgccgcgcctggaactccttcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagcgcgcctccctcatcgaggtcaagacctgcctctggcccaagacccacaccctctggtccaacggcgtcctcgagtcccagatgctcatccccaagtcctacgccggccccttctcccagcacaactaccgccagggctacgccacccagaccgtcggcccctggcacctcggcaagctcgagatcgacttcggcgagtgccccggcaccaccgtcaccatccaggagaactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcaccgccggccagggcacctccgagaccttctccatgggcctcctctgcctcaccctcttcgtcgaggagtgcctccgccgccgcgtcacccgcaagcacatgatcctcgccgtcgtcatcaccctctgcgccatcatcctcggcggcctcacctggatggacctcctccgcgccctcatcatgctcggcgacaccatgtccggccgcatcggcggccagacccacctcgccatcatggccgtcttcaagatgtcccccggctacgtcctcggcgtcttcctccgcaagctcacctcccgcgagaccgccctcatggtcatcggcatggccatgaccaccaccctctccatcccccacgacctcatggagctcatcgacggcatctccctcggcctcatcctcctcaagatcgtcacccagttcgacaacacccaggtcggcaccctcgccctctccctcaccttcatccgctccaccatgtccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccatcaccatgaccctctggtacatgtggcaggtcaagacccagcgctccggcgccctctgggacgtcccctcccccgccgccacccagaaggccgccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgccccaagtggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcaccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagcacgccgtctcccgcggctcctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgcaagcacggcggcaacctcgtccgctgccccctctcccgcaactccacccacgagatgtactgggtctccggcgcctccggcaacatcgtctcctccgtcaacaccacctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatggtcatgaccaccaccgccaactggctctgggccctcctcggcaagaagaagaacccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggagatcgacaagaaggacggcgacctcatgtacgccgacgacaccgccggctgggacacccgcatcaccgaggacgacctccagaacgaggagctcatcaccgagcagatggccccccaccacaagatcctcgccaaggccatcttcaagctcacctaccagaacaaggtcgtcaaggtcctccgccccaccccccgcggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctccgcgagtgcggcgtcgaccgcctcaagcgcatggccatctccggcgacgactgcgtcgtcaagcccctcgacgagcgcttcggcacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgatcgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgtcatgaagcgctactccgccccctccgagtccgagggcgtcctctga

SEQ ID NO: 13111 - RNA, 9867 nt, synthetic construct
  misc_feature 1..9867: note = derived and/or modified CDS sequence (opt2) from DENV-4__GQ199876__SS-prME
  source 1..9867: mol_type = other RNA
tccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggccctcatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccaccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcatcggccgcgtcatctccgccacccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggtccggccgcgagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgcctccgacctcaagtactcctggaagacctggggcaaggccaagatcttcacccccgaggcccgcaactccaccttcctcatcgacggccccgacacctccgagtgccccaacgagcgccgcgcctggaactccttcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagcgcgcctccctcatcgaggtcaagacctgcctctggcccaagacccacaccctctggtccaacggcgtcctcgagtcccagatgctcatccccaagtcctacgccggccccttctcccagcacaactaccgccagggctacgccacccagaccgtcggcccctggcacctcggcaagctcgagatcgacttcggcgagtgccccggcaccaccgtcaccatccaggagaactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcaccgccggccagggcacctccgagaccttctccatgggcctcctctgcctcaccctcttcgtcgaggagtgcctccgccgccgcgtcacccgcaagcacatgatcctcgccgtcgtcatcaccctctgcgccatcatcctcggcggcctcacctggatggacctcctccgcgccctcatcatgctcggcgacaccatgtccggccgcatcggcggccagacccacctcgccatcatggccgtcttcaagatgtcccccggctacgtcctcggcgtcttcctccgcaagctcacctcccgcgagaccgccctcatggtcatcggcatggccatgaccaccaccctctccatcccccacgacctcatggagctcatcgacggcatctccctcggcctcatcctcctcaagatcgtcacccagttcgacaacacccaggtcggcaccctcgccctctccctcaccttcatccgctccaccatgtccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccatcaccatgaccctctggtacatgtggcaggtcaagacccagcgctccggcgccctctgggacgtcccctcccccgccgccacccagaaggccgccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccgtccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgccccaagtggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcaccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagcacgccgtctcccgcggctcctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgcaagcacggcggcaacctcgtccgctgccccctctcccgcaactccacccacgagatgtactgggtctccggcgcctccggcaacatcgtctcctccgtcaacaccacctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatggtcatgaccaccaccgccaactggctctgggccctcctcggcaagaagaagaacccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggagatcgacaagaaggacggcgacctcatgtacgccgacgacaccgccggctgggacacccgcatcaccgaggacgacctccagaacgaggagctcatcaccgagcagatggccccccaccacaagatcctcgccaaggccatcttcaagctcacctaccagaacaaggtcgtcaaggtcctccgccccaccccccgcggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctccgcgagtgcggcgtcgaccgcctcaagcgcatggccatctccggcgacgactgcgtcgtcaagcccctcgacgagcgcttcggcacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgaccgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgtcatgaagcgctactccgccccctccgagtccgagggcgtcctctga

SEQ ID NO: 13112 - RNA, 9867 nt, synthetic construct
  misc_feature 1..9867: note = derived and/or modified CDS sequence (opt2) from DENV-4__KP723482__SS-prME
  source 1..9867: mol_type = other RNA
tccaccatgaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggcctccatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttcctctgctccggcaagatcaccggcaacctcgtccagatcgagaacctcgagtacaccgtcgtcgtcaccgtccacaacggcaacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccgccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcatcatctcctccacccccttcgccgagaacaccaactccgtcaccaacatcgagctcgagccccccttcggcgactcctacatcgtcatcggcgtcggcgactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggaacggcaaggagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgtcaacgacctcaagtactcctggaagacctggggcaaggccaagatcttcacccccgaggcccgcaactccaccttcctcatcgacggccccgacacctccgagtgccccaacgagcgccgcgcctggaacttcttcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagaaggcctccctcatcgaggtcaagacctgcctctggcccaagacccacaccctctggtccaacggcgtcctcgagtcccagatgctcatcccccgctcctacgccggccccttctcccagcacaactaccgccagggctacgccacccagaccgccggcccctggcacctcggcaagctcgagatcgacttcggcgagtgccccggcaccaccgtcaccatccaggaggactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcaccgccggccagggcacctccgagaccttctccatgggcctcctctgcctcaccctcttcgtcgaggagtgcctccgccgccgcgtcacccgcaagcacatgatcctcgccgtcgtcatcaccttctgcgccatcatcctcggcggcctcacctggatggacctcctccgcgtcctcatcatgctcggcgacaccatgtccggccgcatcggcggccagatccacctcgccatcatggccgtcttcaagatgtcccccggctacgtcctcggcgtcttcctccgcaagctcacctcccgcgagaccgccctcatggtcatcggcatggccatgaccaccgtcttctccatcccccacgacctcatggagctcatcgacggcatctccctcggcctcatcctcctcaagatcgtcacccacttcgacaacacccaggtcggcaccctcgccctctccctcaccttcatccgctccaccacccccctcgtcatggcctggcgcaccatcatggccgtcttcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccgtcaccatggccctctggtacgtctggcaggtcaagacccagcgctccggcgccctctgggacgtcccctccccctccgccacccagaaggccaccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaacaagaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctgctccgtcgccgcccgcggctacatctccacccgcgtcgagatgggcgaggccgccgccatcttcatgaccgccaccccccccggctccatcgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagcgcgtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgccccaagtggctcgacgcccgcgtctacgccgaccccatggccctcaaggacttcaaggagttcgcctccggccgcaagtccatcaccctcgacatcctcaccgagatcgccaccctccccacctacctctcctccaaggccaagctcgccctcgacaacatcgtcatgctccacaccaccgagaagggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcgccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagcccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgtcggccagctcctcctcatgcgcaccacctgggccctctgcgaggtcctcaccctcgccaccggccccgtcatgaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctccgcgacggcaccaagatcaagtacgccgtctcccgcggctcctccaagatccgctggatcgtcgagcgcggcatgatcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgccgccacggcggctccctcgtccgctgccccctctcccgcaactccacccacgagatgtactgggtctccggcgcctccggcaacatcgtctcctccgtcaacaccatctccaagatgctcctcaaccgcttcaccacccgccaccgcaagcccacctacgagaaggacgtcgacctcggcgccggcacccgctccgtctccaccgagaccgagaagcccgacatgaccgtcatcggccgccgcctccagcgcctccgcgaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatgatcatgaccaccaccgccaactggctctgggccctcctcggcaagaagaagtccccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttctcccgcgagaactcctggtccggcgtcgagggcgagggcctccaccgcctcggctacatcctcgaggacatcgacaagaaggacggcgacctcatctacgccgacgacaccgccggctgggacacccgcatcaccgaggacgacctcctcaacgaggagctcatcaccgagcagatggccccccaccacaagaccctcgccaaggccatcttcaagctcacctaccagaacaaggtcgtcaaggtcctccgccccacccccaagggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctcaaggagtgcggcgtcgaccgcctcaagcgcatggccatctccggcgacgactgcgtcgtcaagcccctcgacgagcgcttctccacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgaccgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgccatgaagcgctactccgcccccttcgagtccgagggcgtcctctga

SEQ ID NO: 13113 - RNA, 9867 nt, synthetic construct
  misc_feature 1..9867: note = derived and/or modified CDS sequence (opt2) from DENV-4__JN638570__SS-prME
  source 1..9867: mol_type = other RNA
tccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccgcctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcatcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcatcaagaccaccgccaaggaggtcgccctcctccgcacctactgcatcgaggcctccatctccaacatcaccaccgccacccgctgccccacccagggcgagccctacctcaaggaggagcaggaccagcagtacatctgccgccgcgacatggtcgaccgcggctggggcaacggctgcggcctcttcggcaagggcggcgtcgtcacctgcgccaagttctcctgcctcggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaccaagacctggctcgtccacaagcagtggttcctcgacctccccctcccctggaccaccggcgccgacaccctcgaggtccactggaaccacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcaccggcgccccctgcaaggtccccatcgagatccgcgacgtcaacaaggagaaggtcgtcggccgcatcatctcctccacccccttcgccgagaacaccaactccgtcaccaacatcgagctcgagccccccttcggcgactcctacatcgtcatcggcgtcggcgacggcgccctcaccctccactggttccgcaagggctcctccatcggcaagatgttcgagtccacctaccgcggcgccaagcgcatggccatcctcggcgagaccgcctgggacttcggctccgtcggcggcctcctcacctccctcggcaaggccgtccaccaggtcttcggctccgtctacaccaccatgttcggcggcgtctcctggatggtccgcatcctcatcggcctcctcgtcctctggatcggcaccaactcccgcaacacctccatggccatgtcctgcatcgccgtcggcggcatcaccctcttcctcggcttcaccgtccacgccgacatgggctgcgtcgtctcctggtccggcaaggagctcaagtgcggctccggcatcttcgtcatcgacaacgtccacacctggaccgagcagtacaagttccagcccgagtcccccgcccgcctcgcctccgccatcctcaacgcccacaaggagggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctctccaagggcaagcgcgccctcgccccccccgtcaacgacctcaagtactcctggaagacctggggcaaggccaagatcttcacccccgagacccgcaactccaccttcctcgtcgacggccccgacacctccgagtgccccaacgagcgccgcgcctggaacttcctcgaggtcgaggactacggcttcggcatgttcaccaccaacatctggatgaagttccgcgagggctcccccgaggtctgcgaccaccgcctcatgtccgccgccatcaaggaccagaaggccgtccacgccgacatgggctactggatcgagtcctccaagaaccagacctggcagatcgagaaggcctccctcatcgaggtcaagacctgcctctggcccaagacccacaccctctggtccaacggcgtcctcgagtcccagatgctcatccccaaggcctacgccggccccatctcccagcacaactaccgccagggctacgccacccagaccgccggcccctggcacctcggcaagctcgagatcgacttcggcgagtgccccggcaccaccgtcaccgtccaggaggactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctcaacgagaaggaggagaacatggtcaagtcccaggtctccgccggccagggcacctccgagaccttctccatgggcctcctctgcctcaccctcttcgtcgaggagtgcctccgccgccgcgtcacccgcaagcacatgatgctcgtcgtcgtcaccaccctctgcgccatcatcctcggcggcctcacctggatggacctcctccgcgccctcatcatgctcggcgacaccatgtccggccgcatgggcggccagatccacctcgccatcatggccgtcttcaagatgtcccccggctacgtcctcggcatcttcctccgcaagctcacctcccgcgagaccgccctcatggtcatcggcatggccatgaccaccgtcctcgccatcccccacgacctcatggagttcatcgacggcatctccctcggcctcatcctcctcaagatggtcacccacttcgacaacacccaggtcggcaccctcgccctcgccctcaccttcatcaagtccaccatgcccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctccaagcgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccgctgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccgtcaccatgaccctctggtacatgtggcaggtcaagacccagcgctccggcgccctctgggacgtcccctcccccgccgccgcccagaaggccaccctcaccgagggcgtctaccgcatcatgcagcgcggcctcttcggcaagacccaggtcggcgtcggcatccacaccgagggcgtcttccacaccatgtggcacgtcacccgcggctccgtcatctgccacgagtccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcaccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctccgcaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgccccaagtggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggcaaggcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcgccatcgccgtcgcctccggcctcctctgggtcgccgagatccagccccagtggatcgccgcctccatcatcctcgagttcttcctcatggtcctcctcgtccccgagcccgagaagcagcgcaccccccaggacaaccagctcatctacgtcatcctcaccatcctcaccatcatcgccctcgtcgccgccaacgagatgggcctcatcgagaagaccaagaccgacttcggcttctaccaggtcaaggccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagtacgccgtctcccgcggcacctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgccgctacggcggctccctcgtccgctgccccctctcccgcaactccacccacgagatgtactgggtctccggcgtctccggcaacatcgtctcctccgtcaacaccacctccaagatgctcctcaaccgcttcaccacccgccaccgcaagcccacctacgagcgcgacgccgacctcggcgccggcacccgctccgtctccaccgagaccgagaagcccgacatgaccatcatcggccgccgcctccagcgcctccaggaggagcacaaggagacctggcactacgaccacgagaacccctaccgcacctgggcctaccacggctcctacgaggccccctccaccggctccgcctcctccatggtcaacggcgtcgtcaagctcctcaccaagccctgggacgtcgtccccatggtcacccagctcgccatgaccgacaccacccccttcggccagcagcgcgtcttcaaggagaaggtcgacacccgcaccccccagcccaagcccggcacccgcgtcgtcatgaccaccaccgccaactggctctggaccctcctcggccgcaagaagaacccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggacatcgacaagaaggacggcgacctcatctacgccgacgacaccgccggctgggacacccgcatcaccgaggacgacctcctcaacgaggagctcatcaccgagcagatggccccccaccacaagatcctcgccaaggccatcttcaagctcacctaccagaacaaggtcgtcaaggtcctccgccccacccccaagggcgccgtcatggacatcatctcccgcaaggaccagcgcggctccggccaggtcggcacctacggcctcaacaccttcaccaacatggaggtccagctcatccgccagatggaggccgagggcgtcatcacccgcgacgacatgcacaaccccaagggcctcaaggagcgcgtcgagaagtggctcaaggagtgcggcgtcgaccgcctcaagcgcatggccatctccggcgacgactgcgtcgtcaagcccctcgacgagcgcttctccacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgatcgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgccatgcgccgctactccgcccacttcgagtccgagggcgtcctctga

SEQ ID NO: 13114 - RNA, 9867 nt, synthetic construct
  misc_feature 1..9867: note = derived and/or modified CDS sequence (opt2) from DENV-4__JN638571__SS-prME
  source 1..9867: mol_type = other RNA
tccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccgcctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcatcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcatcaagaccaccgccaaggaggtcgccctcctccgcacctactgcatcgaggcctccatctccaacatcaccaccgccacccgctgccccacccagggcgagccctacctcaaggaggagcaggaccagcagtacatctgccgccgcgacatggtcgaccgcggctggggcaacggctgcggcctcttcggcaagggcggcgtcgtcacctgcgccaagttctcctgcctcggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgagtacggcgagctcaccctcgactgcgagccccgctccggcatcgacttcaacgagatgatcctcatgaagatgaagaccaagacctggctcgtccacaagcagtggttcctcgacctccccctcccctggaccaccggcgccgacaccctcgaggtccactggaaccacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcaccggcgccccctgcaaggtccccatcgagatccgcgacgtcaacaaggagaaggtcgtcggccgcatcatctcctccacccccttcgccgagaacaccaactccgtcaccaacatcgagctcgagccccccttcggcgactcctacatcgtcatcggcgtcggcgacggcgccctcaccctccactggttccgcaagggctcctccatcggcaagatgttcgagtccacctaccgcggcgccaagcgcatggccatcctcggcgagaccgcctgggacttcggctccgtcggcggcctcctcacctccctcggcaaggccgtccaccaggtcttcggctccgtctacaccaccatgttcggcggcgtctcctggatggtccgcatcctcatcggcctcctcgtcctctggatcggcaccaactcccgcaacacctccatggccatgtcctgcatcgccgtcggcggcatcaccctcttcctcggcttcaccgtccacgccgacatgggctgcgtcgtctcctggtccggcaaggagctcaagtgcggctccggcatcttcgtcatcgacaacgtccacacctggaccgagcagtacaagttccagcccgagtcccccgcccgcctcgcctccgccatcctcaacgcccacaaggagggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctctccaagggcaagcgcgccctcgccccccccgtcaacgacctcaagtactcctggaagacctggggcaaggccaagatcttcacccccgagacccgcaactccaccttcctcgtcgacggccccgacacctccgagtgccccaacgagcgccgcgcctggaacttcctcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagaaggcctccctcatcgaggtcaagacctgcctctggcccaagacccacaccctctggtccaacggcgtcctcgagtcccagatgctcatccccaaggcctacgccggccccatctcccagcacaactaccgccagggctacgccacccagaccgccggcccctggcacctcggcaagctcgagatcgacttcggcgagtgccccggcaccaccgtcaccgtccaggaggactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctcaacgagaaggaggagaacatggtcaagtcccaggtctccgccggccagggcacctccgagaccttctccatgggcctcctctgcctcaccctcttcgtcgaggagtgcctccgccgccgcgtcacccgcaagcacatgatgctcgtcgtcgtcaccaccctctgcgccatcatcctcggcggcctcacctggatggacctcctccgcgccctcatcatgctcggcgacaccatgtccggccgcatgggcggccagatccacctcgccatcatggccgtcttcaagatgtcccccggctacgtcctcggcatcttcctccgcaagctcacctcccgcgagaccgccctcatggtcatcggcatggccatgaccaccgtcctcgccatcccccacgacctcatggagttcatcgacggcatctccctcggcctcatcctcctcaagatggtcacccacttcgacaacacccaggtcggcaccctcgccctcgccctcaccttcatcaagtccaccatgcccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctccaagcgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccgctgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccgtcaccatgaccctctggtacatgtggcaggtcaagacccagcgctccggcgccctctgggacgtcccctcccccgccgccgcccagaaggccaccctcaccgagggcgtctaccgcatcatgcagcgcggcctcttcggcaagacccaggtcggcgtcggcatccacaccgagggcgtcttccacaccatgtggcacgtcacccgcggctccgtcatctgccacgagtccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcaccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctccgcaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgccccaagtggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggcaaggcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcgccatcgccgtcgcctccggcctcctctgggtcgccgagatccagccccagtggatcgccgcctccatcatcctcgagttcttcctcatggtcctcctcgtccccgagcccgagaagcagcgcaccccccaggacaaccagctcatctacgtcatcctcaccatcctcaccatcatcgccctcgtcgccgccaacgagatgggcctcatcgagaagaccaagaccgacttcggcttctaccaggtcaaggccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagtacgccgtctcccgcggcacctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgccgctacggcggctccctcgtccgctgccccctctcccgcaactccacccacgagatgtactgggtctccggcgtctccggcaacatcgtctcctccgtcaacaccacctccaagatgctcctcaaccgcttcaccacccgccaccgcaagcccacctacgagcgcgacgccgacctcggcgccggcacccgctccgtctccaccgagaccgagaagcccgacatgaccatcatcggccgccgcctccagcgcctccaggaggagcacaaggagacctggcactacgaccacgagaacccctaccgcacctgggcctaccacggctcctacgaggccccctccaccggctccgcctcctccatggtcaacggcgtcgtcaagctcctcaccaagccctgggacgtcgtccccatggtcacccagctcgccatgaccgacaccacccccttcggccagcagcgcgtcttcaaggagaaggtcgacacccgcaccccccagcccaagcccggcacccgcgtcgtcatgaccaccaccgccaactggctctggaccctcctcggccgcaagaagaacccccgcctctgcacccgcgaggagttcatctccaaggtccgcctcaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggacatcgacaagaaggacggcgacctcatctacgccgacgacaccgccggctgggacacccgcatcaccgaggacgacctcctcaacgaggagctcatcaccgagcagatggccccccaccacaagatcctcgccaaggccatcttcaagctcacctaccagaacaaggtcgtcaaggtcctccgccccacccccaagggcgccgtcatggacatcatctcccgcaaggaccagcgcggctccggccaggtcggcacctacggcctcaacaccttcaccaacatggaggtccagctcatccgccagatggaggccgagggcgtcatcacccgcgacgacatgcacaaccccaagggcctcaaggagcgcgtcgagaagtggctcaaggagtgcggcgtcgaccgcctcaagcgcatggccatctccggcgacgactgcgtcgtcaagcccctcgacgagcgcttctccacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgatcgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgccatgcgccgctactccgcccacttcgagtccgagggcgtcctctga

SEQ ID NO: 13115 - RNA, 9867 nt, synthetic construct
  misc_feature 1..9867: note = derived and/or modified CDS sequence (opt2) from DENV-4__JN638572__SS-prME
  source 1..9867: mol_type = other RNA
tccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccgcctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcatcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcatcaagaccaccgccaaggaggtcgccctcctccgcacctactgcatcgaggcctccatctccaacatcaccaccgccacccgctgccccacccagggcgagccctacctcaaggaggagcaggaccagcagtacatctgccgccgcgacatggtcgaccgcggctggggcaacggctgcggcctcttcggcaagggcggcgtcgtcacctgcgccaagttctcctgcctcggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgagtacggcgagctcaccctcgactgcgagccccgctccggcatcgacttcaacgagatgatcctcatgaagatgaagaccaagacctggctcgtccacaagcagtggttcctcgacctccccctcccctggaccaccggcgccgacaccctcgaggtccactggaaccacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcaccggcgccccctgcaaggtccccatcgagatccgcgacgtcaacaaggagaaggtcgtcggccgcatcatctcctccacccccttcgccgagaacaccaactccgtcaccaacatcgagctcgagccccccttcggcgactcctacatcgtcatcggcgtcggcgacggcgccctcaccctccactggttccgcaagggctcctccatcggcaagatgttcgagtccacctaccgcggcgccaagcgcatggccatcctcggcgagaccgcctgggacttcggctccgtcggcggcctcctcacctccctcggcaaggccgtccaccaggtcttcggctccgtctacaccaccatgttcggcggcgtctcctggatggtccgcatcctcatcggcctcctcgtcctctggatcggcaccaactcccgcaacacctccatggccatgtcctgcatcgccgtcggcggcatcaccctcttcctcggcttcaccgtccacgccgacatgggctgcgtcgtctcctggtccggcaaggagctcaagtgcggctccggcgtcttcgtcatcgacaacgtccacacctggaccgagcagtacaagttccagcccgagtcccccgcccgcctcgcctccgccatcctcaacgcccacaaggagggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctctccaagggcaagcgcgccctcgccccccccgtcaacgacctcaagtactcctggaagacctggggcaaggccaagatcttcacccccgagacccgcaactccaccttcctcgtcgacggccccgacacctccgagtgccccaacgagcgccgcgcctggaacttcctcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagaaggcctccctcatcgaggtcaagacctgcctctggcccaagacccacaccctctggtccaacggcgtcctcgagtcccagatgctcatccccaaggcctacgccggccccatctcccagcacaactaccgccagggctacgccacccagaccgccggcccctggcacctcggcaagctcgagatcgacttcggcgagtgccccggcaccaccgtcaccgtccaggaggactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctcaacgagaaggaggagaacatggtcaagtcccaggtctccgccggccagggcacctccgagaccttctccatgggcctcctctgcctcaccctcttcgtcgaggagtgcctccgccgccgcgtcacccgcaagcacatgatcctcgtcgtcgtcaccaccctctgcgccatcatcctcggcggcctcacctggatggacctcctccgcgccctcatcatgctcggcgacaccatgtccggccgcatgggcggccagatccacctcgccatcatggccgtcttcaagatgtcccccggctacgtcctcggcatcttcctccgcaagctcacctcccgcgagaccgccctcatggtcatcggcatggccatgaccaccgtcctcgccatcccccacgacctcatggagttcatcgacggcatctccctcggcctcatcctcctcaagatggtcacccacttcgacaacacccaggtcggcaccctcgccctcgccctcaccttcatcaagtccaccatgcccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctccaagcgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccgctgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccgtcaccatgaccctctggtacatgtggcaggtcaagacccagcgctccggcgccctctgggacgtcccctcccccgccgccgcccagaaggccaccctcaccgagggcgtctaccgcatcatgcagcgcggcctcttcggcaagacccaggtcggcgtcggcatccacaccgagggcgtcttccacaccatgtggcacgtcacccgcggctccgtcatctgccacgagtccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcaccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctccgcaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgccccaagtggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggcaaggcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcgccatcgccgtcgcctccggcctcctctgggtcgccgagatccagccccagtggatcgccgcctccatcatcctcgagttcttcctcatggtcctcctcgtccccgagcccgagaagcagcgcaccccccaggacaaccagctcatctacgtcatcctcaccatcctcaccatcatcgccctcgtcgccgccaacgagatgggcctcatcgagaagaccaagaccgacttcggcttctaccaggtcaaggccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgtcggccagctcctcctcatgcgcaccacctgggccctctgcgaggtcctcaccctcgccaccggccccatcatgaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctccgcgacggctccaagaccaagcacgccgtctcccgcggctcctccaagatccgctggatcgtcgagcgcggcatgatcaagcccaagggcaaggtcgtcgacctcggctgcggccgcggcggctggtcctactacatggccaccctccagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgccgctacggcggctccctcgtccgctgccccctctcccgcaactccacccacgagatgtactgggtctccggcgtctccggcaacatcgtctcctccgtcaacaccacctccaagatgctcctcaaccgcttcaccacccgccaccgcaagcccacctacgagcgcgacgccgacctcggcgccggcacccgctccgtctccaccgagaccgagaagcccgacatgaccatcatcggccgccgcctccagcgcctccaggaggagcacaaggagacctggcactacgaccacgagaacccctaccgcacctgggcctaccacggctcctacgaggccccctccaccggctccgcctcctccatggtcaacggcgtcgtcaagctcctcaccaagccctgggacgtcgtccccatggtcacccagctcgccatgaccgacaccacccccttcggccagcagcgcgtcttcaaggagaaggtcgacacccgcaccccccagcccaagcccggcacccgcgtcgtcatgaccaccaccgccaactggctctggaccctcctcggccgcaagaagaacccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggacatcgacaagaaggacggcgacctcatctacgccgacgacaccgccggctgggacacccgcatcaccgaggacgacctcctcaacgaggagctcatcaccgagcagatggccccccaccacaaggtcctcgccaaggccatcttcaagctcacctaccagaacaaggtcgtcaaggtcctccgccccacccccaagggcgccgtcatggacatcatctcccgcaaggaccagcgcggctccggccaggtcggcacctacggcctcaacaccttcaccaacatggaggtccagctcatccgccagatggaggccgagggcgtcatcacccgcgacgacatgcacaaccccaagggcctcaaggagcgcgtcgagaagtggctcaaggagtgcggcgtcgaccgcctcaagcgcatggccatctccggcgacgactgcgtcgtcaagcccctcgacgagcgcttctccacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgaccgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacatggactacatgcccgtcatgaagcgctactccgccccctccgagtccgagggcgtcctctga

SEQ ID NO: 13116 - RNA, 9867 nt, synthetic construct
  misc_feature 1..9867: note = derived and/or modified CDS sequence (opt2) from DENV-4__JX024757__SS-prME
  source 1..9867: mol_type = other RNA
tccaccatgaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggcctccatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttcctctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggtccgccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcatcatctcctccacccccttcgccgagaacaccaactccgtcaccaacatcgagctcgagccccccttcggcgactcctacatcgtcatcggcgtcggcgactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggaacggcaaggagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgtcaacgacctcaagtactcctggaagacctggggcaaggccaagatcttcacccccgaggcccgcaactccaccttcctcatcgacggccccgacacctccgagtgccccaacggccgccgcgcctggaacttcctcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagaaggcctccctcatcgaggtcaagacctgcctctggcccaagacccacaccctctggtccaacggcgtcctcgagtcccagatgctcatcccccgctcctacgccggccccttctcccagcacaactaccgccagggctacgccacccagaccgccggcccctggcacctcggcaagctcgagatcgacttcggcgagtgccccggcaccaccgtcaccatccaggaggactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcaccgccggccagggcacctccgagaccttctccatgggcctcctctgcctcaccctcttcgtcgaggagtgcctccgccgccgcgtcacccgcaagtacatgatgctcgtcgtcgtcatcaccttctgcgccatcatcctcggcggcctcacctggatggacctcctccgcgccctcatcatgctcggcgacaccatgtccggccgcatcggcggccagatccacctcgccatcatggccgtcttcaagatgtcccccggctacgtcctcggcgtcttcctccgcaagctcacctcccgcgagaccgccctcatggtcatcggcatggccatgaccaccgtcttctccatcccccacgacctcatggagctcatcgacggcatctccctcggcctcatcctcctccgcatcgtcacccacttcgacaacacccaggtcggcaccctcgccctctccctcaccttcatccgctccaccacccccctcgtcatggcctggcgcaccatcatggccgtcttcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccgtcaccatggccctctggtacatctggcaggtcaagacccagcgctccggcgccctctgggacgtcccctcccccgccgccacccagaaggccaccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaacaagaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctgctccgtcgccgcccgcggctacatctccacccgcgtcgagatgggcgaggccgccgccatcttcatgaccgccaccccccccggctccatcgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagcgcgtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgccccaagtggctcgacgcccgcgtctacgccgaccccatggccctcaaggacttcaaggagttcgcctccggccgcaagtccatcaccctcgacatcctcaccgagatcgccaccctccccacctacctctcctccaaggccaagctcgccctcgacaacatcgtcatgctccacaccaccgagaagggcggccgcgcctaccagcacgccctcaacgagctccccgagtccctcgagaccctcatgctcgtcgccctcctcggcgccctcaccgccggcatcttcctcttcttcatgcagggcaagggcatcggcaagctctccatgggcctcatcgccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgtcggccagctcctcctcatgcgcaccacctgggccctctgcgaggtcctcaccctcgccaccggccccatcatgaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctccgcgacggctccaagatcaagcacgccgtctcccgcggctcctccaagatccgctggatcgtcgagcgcggcatgatcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgccgccacggcggctccctcgtccgctgccccctctcccgcaactccacccacgagatgtactgggtctccggcgcctccggcaacatcgtctcctccgtcaacaccatctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccgcgaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatgatcatgaccatgaccgccaactggctctgggccctcctcggcaagaagaagtccccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttctcccgcgagaactcctggtccggcgtcgagggcgagggcctccaccgcctcggctacatcctcgaggacatcgacaagaaggacggcgacctcatctacgccgacgacaccgccggctgggacacccgcatcaccgaggacgacctcctcaacgaggagctcatcaccgagcagatggccccccaccacaagaccctcgccaaggccatcttcaagctcacctaccagaacaaggtcgtcaaggtcctccgccccacccccaagggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaacccccgcggcctcaaggagcgcgtcgagaagtggctcaaggagtgcggcgtcgaccgcctcaagcgcatggccatctccggcgacgactgcgtcgtcaagcccatcgacgagcgcttctccacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgaccgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgccatgaagcgctactccgcccccttcgagtccgagggcgtcctctga

SEQ ID NO: 13117 - RNA, 9867 nt, synthetic construct
  misc_feature 1..9867: note = derived and/or modified CDS sequence (opt2) from DENV-4__JF741967__SS-prME
  source 1..9867: mol_type = other RNA
tccaccatgaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggcctccatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttcctctgctccggcaagatcaccggcaacctcgtccagatcgagaacctcgagtacaccgtcgtcgtcaccgtccacaacggcaacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccgccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcatcatctcctccacccccttcgccgagaacaccaactccgtcaccaacatcgagctcgagccccccttcggcgactcctacatcgtcatcggcgtcggcgactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggaacggcaaggagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgtcaacgacctcaagtactcctggaagacctggggcaaggccaagatcttcacccccgaggcccgcaactccaccttcctcatcgacggccccgacacctccgagtgccccaacgagcgccgcgcctggaacttcttcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagaaggcctccctcatcgaggtcaagacctgcctctggcccaagacccacaccctctggtccaacggcgtcctcgagtcccagatgctcatcccccgctcctacgccggccccttctcccagcacaactaccgccagggctacgccacccagaccgccggcccctggcacctcggcaagctcgagatcgacttcggcgagtgccccggcaccaccgtcaccatccaggaggactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcaccgccggccagggcacctccgagaccttctccatgggcctcctctgcctcaccctcttcgtcgaggagtgcctccgccgccgcgtcacccgcaagcacatgatcctcgccgtcgtcatcaccttctgcgccatcatcctcggcggcctcacctggatggacctcctccgcgtcctcatcatgctcggcgacaccatgtccggccgcatcggcggccagatccacctcgccatcatggccgtcttcaagatgtcccccggctacgtcctcggcgtcttcctccgcaagctcacctcccgcgagaccgccctcatggtcatcggcatggccatgaccaccgtcttctccatcccccacgacctcatggagctcatcgacggcatctccctcggcctcatcctcctcaagatcgtcacccacttcgacaacacccaggtcggcaccctcgccctctccctcaccttcatccgctccaccacccccctcgtcatggcctggcgcaccatcatggccgtcttcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgaggtcgaggagaccaacatgatcaccctcctcgtcaagctcgccctcatcaccgtctccggcctctaccccctcgccatccccgtcaccatggccctctggtacgtctggcaggtcaagacccagcgctccggcgccctctgggacgtcccctcccccgccgccacccacaaggccaccctctccgagggcgtctaccgcatcatgcagcgcggcctcttcggcaagacccaggtcggcgtcggcatccacatggagggcgtcttccacaccgtcggccacgtcacccgcggctccgtcatctgccacgagaccggccgcctcgagccctcctggggcgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaacaagaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctgctccgtcgccgcccgcggctacatctccacccgcgtcgagatgggcgaggccgccgccatcttcatgaccgccaccccccccggctccatcgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagcgcgtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgccccaagtggctcgacgcccgcgtctacgccgaccccatggccctcaaggacttcaaggagttcgcctccggccgcaagtccatcaccctcgacatcctcaccgagatcgccaccctccccacctacctctcctccaaggccaagctcgccctcgacaacatcgtcatgctccacaccaccgagaagggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcgccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagcccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgtcggccagctcctcctcatgcgcaccacctgggccctctgcgaggtcctcaccctcgccaccggccccgtcatgaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctccgcgacggcaccaagatcaagtacgccgtctcccgcggctcctccaagatccgctggatcgtcgagcgcggcatgatcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgccgccacggcggctccctcgtccgctgccccctctcccgcaactccacccacgagatgtactgggtctccggcgcctccggcaacatcgtctcctccgtcaacaccatctccaagatgctcctcaaccgcttcaccacccgccaccgcaagcccacctacgagaaggacgtcgacctcggcgccggcacccgctccgtctccaccgagaccgagaagcccgacatgaccgtcatcggccgccgcctccagcgcctccgcgaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatgatcatgaccaccaccgccaactggctctgggccctcctcggcaagaagaagtccccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttctcccgcgagaactcctggtccggcgtcgagggcgagggcctccaccgcctcggctacatcctcgaggacatcgacaagaaggacggcgacctcatctacgccgacgacaccgccggctgggacacccgcatcaccgaggacgacctcctcaacgaggagctcatcaccgagcagatggccccccaccacaagaccctcgccaaggccatcttcaagctcacctaccagaacaaggtcgtcaaggtcctccgccccacccccaagggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctcaaggagtgcggcgtcgaccgcctcaagcgcatggccatctccggcgacgactgcgtcgtcaagcccctcgacgagcgcttctccacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgaccgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgccatgaagcgctactccgcccccttcgagtccgagggcgtcctctga

SEQ ID NO: 13118 - RNA, 9867 nt, synthetic construct
  misc_feature 1..9867: note = derived and/or modified CDS sequence (opt2) from DENV-4__JQ822247__SS-prME
  source 1..9867: mol_type = other RNA
tccaccatgaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggcctccatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttcctctgctccggcaagatcaccggcaacctcgtccagatcgagaacctcgagtacaccgtcgtcgtcaccgtccacaacggcaacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccgccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcatcatctcctccacccccttcgccgagaacaccaactccgtcaccaacatcgagctcgagccccccttcggcgactcctacatcgtcatcggcgtcggcgactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggaacggcaaggagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgtcaacgacctcaagtactcctggaagacctggggcaaggccaagatcttcacccccgaggcccgcaactccaccttcctcatcgacggccccgacacctccgagtgccccaacgagcgccgcgcctggaacttcttcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagaaggcctccctcatcgaggtcaagacctgcctctggcccaagacccacaccctctggtccaacggcgtcctcgagtcccagatgctcatcccccgctcctacgccggccccttctcccagcacaactaccgccagggctacgccacccagaccgccggcccctggcacctcggcaagctcgagatcgacttcggcgagtgccccggcaccaccgtcaccatccaggaggactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcaccgccggccagggcacctccgagaccttctccatgggcctcctctgcctcaccctcttcgtcgaggagtgcctccgccgccgcgtcacccgcaagcacatgatcctcgccgtcgtcatcaccttctgcgccatcatcctcggcggcctcacctggatggacctcctccgcgtcctcatcatgctcggcgacaccatgtccggccgcatcggcggccagatccacctcgccatcatggccgtcttcaagatgtcccccggctacgtcctcggcgtcttcctccgcaagctcacctcccgcgagaccgccctcatggtcatcggcatggccatgaccaccgtcttctccatcccccacgacctcatggagctcatcgacggcatctccctcggcctcatcctcctcaagatcgtcacccacttcgacaacacccaggtcggcaccctcgccctctccctcaccttcatccgctccaccacccccctcgtcatggcctggcgcaccatcatggccgtcttcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccgtcaccatggccctctggtacgtctggcaggtcaagacccagcgctccggcgccctctgggacgtcccctcccccgccgccacccagaaggccaccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaacaagaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctgctccgtcgccgcccgcggctacatctccacccgcgtcgagatgggcgaggccgccgccatcttcatgaccgccaccccccccggctccatcgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagcgcgtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgccccaagtggctcgacgcccgcgtctacgccgaccccatggccctcaaggacttcaaggagttcgcctccggccgcaagtccatcaccctcgacatcctcaccgagatcgccaccctccccacctacctctcctccaaggccaagctcgccctcgacaacatcgtcatgctccacaccaccgagaagggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcgccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagcccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgtcggccagctcctcctcatgcgcaccacctgggccctctgcgaggtcctcaccctcgccaccggccccgtcatgaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctccgcgacggcaccaagatcaagtacgccgtctcccgcggctcctccaagatccgctggatcgtcgagcgcggcatgatcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgccgccacggcggctccctcgtccgctgccccctctcccgcaactccacccacgagatgtactgggtctccggcgcctccggcaacatcgtctcctccgtcaacaccatctccaagatgctcctcaaccgcttcaccacccgccaccgcaagcccacctacgagaaggacgtcgacctcggcgccggcacccgctccgtctccaccgagaccgagaagcccgacatgaccgtcatcggccgccgcctccagcgcctccgcgaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatgatcatgaccaccaccgccaactggctctgggccctcctcggcaagaagaagtccccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttctcccgcgagaactcctggtccggcgtcgagggcgagggcctccaccgcctcggctacatcctcgaggacatcgacaagaaggacggcgacctcatctacgccgacgacaccgccggctgggacacccgcatcaccgaggacgacctcctcaacgaggagctcatcaccgagcagatggccccccaccacaagaccctcgccaaggccatcttcaagctcacctaccagaacaaggtcgtcaaggtcctccgccccacccccaagggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctcaaggagtgcggcgtcgaccgcctcaagcgcatggccatctccggcgacgactgcgtcgtcaagcccctcgacgagcgcttctccacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgaccgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgccatgaagcgctactccgcccccttcgagtccgagggcgtcctctga

SEQ ID NO: 13119 - RNA, 9867 nt, synthetic construct
  misc_feature 1..9867: note = derived and/or modified CDS sequence (opt2) from DENV-4__JF262783__SS-prME
  source 1..9867: mol_type = other RNA
tccaccgtcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcatgtacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcatcaagaccaccgccaaggaggtcaccctcctccgcacctactgcatcgaggcctccatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttcctctgctccggcaagatcaccggcaacctcgtccagatcgagaacctcgagtacaccgtcgtcgtcaccgtccacaacggcgacacccacgtcgtcggcaaggacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccgccggcgccgacacctccgaggtccagtggaactacaaggagcgcatggtcaccttcaaggtcccccacgccaagcgccaggacgtcaccgtcctcggctcccaggagggcgccatgcactccgccctcaccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcatcatctcctccacccccttcgccgagaacaccaactccgtcaccaacatcgagctcgagccccccttcggcgactcctacatcgtcatcggcgtcggcgactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatggtccgcatcctcatcggcctcctcgtcctctggatcggcaccaactcccgcaacacctccatggccatgacctgcatcgccatcggcggcatcaccctcttcctcggcttcaccgtccacgccgacatgggctgcgccgtctcctggtccggcaaggagctcaagtgcggctccggcatcttcgtcatcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgtcaacgacctcaagtactcctggaagacctggggcaaggccaagatcttcacccccgaggcccgcaactccaccttcctcatcgacggccccgacacctccgagtgccccaacgagcgccgcgcctggaacttcctcgaggtcgaggactacggcttcggcatgttcgccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagaaggcctccctcatcgaggtcaagacctgcctctggcccaagacccacaccctctggtccaacgaggtcctcgagtcccagatgctcatccccaaggcctacgccggccccttctcccagcacaactaccgccagggctacgccacccagaccatcggcccctggcacctcggcaagctcgagatcgacttcggcgagtgccccggcaccaccgtcaccatccaggaggactgcaaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtctccgccggccagggcacctccgagaccttctccatgggcctcctctgcctcaccctcttcgtcgaggagtgcctccgccgccgcgtcacccgcaagcacatgatcctcgtcgtcgtcaccaccctctgcgccatcatcctcggcggcctcacctggatggacctcctccgcgccctcatcatgctcggcgacaccatgtccggccgcatgggcggccagatccacctcaccatcatggccgtcttcaagatgtcccccggctacgtcctcggcgtcttcctccgcaagctcacctcccgcgagaccgccctcatcgtcatcggcatggccatgaccaccgtcctctccatcccccacgacctcatggagttcatcgacggcatctccctcggcctcatcctcctcaagatggtcgcccacttcgacaacacccaggtcggcaccctcgccctctccctcaccttcatccgctccaccatgcccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctccaagcgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccgtcaccatggccctctggtacatgtggcaggtcaagacccagcgctccggcgccctctgggacgtcccctcccccgccgccgcccagaaggccaccctcaccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaacaagaagggccgcgtcatcggcctctacggcaacggcatcgtcaccaagtccggcgactacgtctccgccatcacccaggccgagcgcatcggcgagcccgactacgaggtcgacgaggacatcttccgcaagaagcgcctcaccgtcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgcccgccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagatccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgccccaagtggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatggccatcgccgtcgcctccggcctcctctgggtcgccgagatccagccccagtggatcgccgcctccatcatcctcgagttcttcctcatggccctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctctccgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgccctctgcgccggccagctcctcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagcacgccgtctcccgcggctcctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgcaagcacggcggctccctcgtccgctgccccctctcccgcaactccacccacgagatgtactgggtctccggcgcctccggcaacatcgtctcctccgtcaacaccacctccaagatgctcctcaaccgcttcaccacccgccaccgcaagcccacctacgagaaggacgtcaacctcggcgccggcacccgctccgtctccaccgagaccgagaagcccgacatgaccatcatcggccgccgcctccagcgcctccgcgaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatggtcatgaccaccaccgccaactggctctgggccctcctcggcaagaagaagtccccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggacatcgacaagaaggacggcgacctcatctacgccgacgacaccgccggctgggacacccgcatcaccgaggacgacctcctcaacgaggagctcatcaccgagcagatggccccccaccaccgcatcctcgccaaggccatcttcaagctcacctaccagaacaaggtcgtcaaggtcctccgccccacccccaagggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctcaaggagtgcggcgtcgaccgcctcaagcgcatggccatctccggcgacgactgcgtcgtcaagcccctcgacgagcgcttctccacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgaccgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgtcatgaagcgctactccgcccccttcgagtccgagggcgtcctctga

SEQ ID NO: 13120 - RNA, 9867 nt, synthetic construct
  misc_feature 1..9867: note = derived and/or modified CDS sequence (opt2) from DENV-4__KU513441__SS-prME
  source 1..9867: mol_type = other RNA
tccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggccctcatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccaccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagcgcgtcgtcggccgcgtcatctccgccacccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggtccggccgcgagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgcctccgacctcaagtactcctggaagacctggggcaaggccaagatcttcacccccgaggcccgcaactccaccttcctcatcgacggccccgacacctccgagtgccccaacgagcgccgcgcctggaactccttcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagcgcgcctccctcatcgaggtcaagacctgcctctggcccaagacccacaccctctggtccaacggcgtcctcgagtcccagatgctcatccccaagtcctacgccggccccttctcccagcacaactaccgccagggctacgccacccagaccgtcggcccctggcacctcggcaagctcgagatcgacttcggcgagtgccccggcaccaccgtcaccatccaggagaactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcaccgccggccagggcacctccgagaccttctccatgggcctcctctgcctcaccctcttcgtcgaggagtgcctccgccgccgcgtcacccgcaagcacatgatcctcgccgtcgtcatcaccctctgcgccatcatcctcggcggcctcacctggatggacctcctccgcgccctcatcatgctcggcgacaccatgtccggccgcatcggcggccagacccacctcgccatcatcgccgtcttcaagatgtcccccggctacgtcctcggcgtcttcctccgcaagctcacctcccgcgagaccgccctcatggtcatcggcatggccatgaccaccaccctctccatcccccacgacctcatggagctcatcgacggcatctccctcggcctcatcctcctcaagatcgtcacccagttcgacaacacccaggtcggcaccctcgccctctccctcaccttcatccgctccaccatgtccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccatcaccatgaccctctggtacatgtggcaggtcaagacccagcgctccggcgccctctgggacgtcccctcccccgccgccacccagaaggccgccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgccccaagtggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcaccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccgccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagcacgccgtctcccgcggctcctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgcaagcacggcggcaacctcgtccgctgccccctctcccgcaactccacccacgagatgtactgggtctccggcgcctccggcaacatcgtctcctccgtcaacaccacctccaagatgctcctcaaccgcttcaccacccgccaccgcaagcccacctacgagaaggacgtcgacctcggcgccggcacccgctccgtctccaccgagatcgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatggtcatgaccaccaccgccaactggctctgggccctcctcggcaagaagaagaacccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggagatcgacaagaaggacggcgacctcatgtacgccgacgacaccgccggctgggacacccgcatcaccgaggacgacctccagaacgaggagctcatcaccgagcagatggccccccaccacaagatcctcgccaaggccatcttcaagctcacctaccagaacaaggtcgtcaaggtcctccgccccaccccccgcggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctccgcgagtgcggcgtcgaccgcctcaagcgcatggccatctccggcgacgactgcgtcgtcaagcccctcgacgagcgcttcggcacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgatcgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgtccgtcatgaagcgctactccgccccctccgagtccgagggcgtcctctga

SEQ ID NO: 13121 - RNA, 9867 nt, synthetic construct
  misc_feature 1..9867: note = derived and/or modified CDS sequence (opt2) from DENV-4__KC762694__SS-prME
  source 1..9867: mol_type = other RNA
tccaccatgaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggcctccatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttcctctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccgccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcatcatctcctccacccccttcgccgagaacaccaactccgtcaccaacatcgagctcgagccccccttcggcgactcctacatcgtcatcggcgtcggcgactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggaacggcaaggagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccacctcccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgtcaacgacctcaagtactcctggaagacctggggcaaggccaagatcttcacccccgaggcccgcaactccaccttcctcatcgacggccccgacacctccgagtgccccaacgagcgccgcgcctggaacttcttcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagaaggcctccctcatcgaggtcaagacctgcctctggcccaagacccacaccctctggtccaacggcgtcctcgagtcccagatgctcatcccccgctcctacgccggccccttctcccagcacaactaccgccagggctacgccacccagaccgccggcccctggcacctcggcaagctcgagatcgacttcggcgagtgccccggcaccaccgtcaccatccaggaggactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcaccgccggccagggcacctccgagaccttctccatgggcctcctctgcctcaccctcttcgtcgaggagtgcctccgccgccgcgtcacccgcaagcacatgatcctcgtcgtcgtcatcaccttctgcgccatcatcctcggcggcctcacctggatggacctcctccgcgccctcatcatgctcggcgacaccatgtccggccgcatcggcggccagatccacctcgccatcatggccgtcttcaagatgtcccccggctacgtcctcggcgtcttcctccgcaagctcacctcccgcgagaccgccctcatggtcatcggcatggccatgaccaccgtcttctccatcccccacgacctcatggagctcatcgacggcatctccctcggcctcatcctcctcaagatcgtcacccacttcgacaacacccaggtcggcaccctcgccctctccctcaccttcatccgctccaccacccccctcgtcatggcctggcgcaccatcatggccgtcttcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccgtcaccatggccctctggtacgtctggcaggtcaagacccagcgctccggcgccctctgggacgtcccctcccccgccgccacccagaaggccaccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaacaagaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctgctccgtcgccgcccgcggctacatctccacccgcgtcgagatgggcgaggccgccgccatcttcatgaccgccaccccccccggctccatcgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagcgcgtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgccccaagtggctcgacgcccgcgtctacgccgaccccatggccctcaaggacttcaaggagttcgcctccggccgcaagtccatcaccctcgacatcctcaccgagatcgccaccctccccacctacctctcctccaaggccaagctcgccctcgacaacatcgtcatgctccacaccaccgagaagggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcgccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgtcggccagctcctcctcatgcgcaccacctgggccctctgcgaggtcctcaccctcgccaccggccccgtcatgaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctccgcgacggctccaagatcaagtacgccgtctcccgcggctcctccaagatccgctggatcgtcgagcgcggcatgatcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgccgccacggcggctccctcgtccgctgccccctctcccgcaactccacccacgagatgtactgggtctccggcgcctccggcaacatcgtctcctccgtcaacaccatctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccgcgaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatgatcatgaccaccaccgccaactggctctgggccctcctcggcaagaagaagtccccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttctcccgcgagaactcctggtccggcgtcgagggcgagggcctccaccgcctcggctacatcctcgaggacatcgacaagaaggacggcgacctcatctacgccgacgacaccgccggctgggacacccgcatcaccgaggacgacctcctcaacgaggagctcatcaccgagcagatggccccccaccacaagaccctcgccaaggccatcttcaagctcacctaccagaacaaggtcgtcaaggtcctccgccccacccccaagggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctcaaggagtgcggcgtcgaccgcctcaagcgcatggccatctccggcgacgactgcgtcgtcaagcccctcgacgagcgcttctccacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgaccgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgccatgaagcgctactccgcccccttcgagtccgagggcgtcctctga

SEQ ID NO: 13122 - RNA, 9867 nt, synthetic construct
  misc_feature 1..9867: note = derived and/or modified CDS sequence (opt2) from DENV-4__KC762695__SS-prME
  source 1..9867: mol_type = other RNA
tccaccatgaccctcctctgcctcatccccaccgccatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactcctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggcctccatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttcctctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccgccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcaacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcatcatctcctccacccccttcgccgagaacaccaactccgtcaccaacatcgagctcgagccccccttcggcgactcctacatcgtcatcggcgtcggcgactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccatccaccaggtcttcggctccgtctacaccaccatgttcggcggcgtctcctggatgatccgcatcctcatcggcctcctcgtcctctggatcggcaccaactcccgcaacacctccatggccatgacctgcatcgccgtcggcggcatcaccctcttcctcggcttcaccgtccaggccgacatgggctgcgtcgtctcctggaacggcaaggagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgtcaacgacctcaagtactcctggaagacctggggcaaggccaagatcttcacccccgaggcccgcaactccaccttcctcatcgacggccccgacacctccgagtgccccaacgagcgccgcgcctggaacttcctcgaggtcgaggactacggcttcggcatgttctccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagaaggcctccctcatcgaggtcaagacctgcctctggcccaagacccacaccctctggtccaacggcgtcctcgagtcccagatgctcatcccccgctcctacgccggccccttctcccagcacaactaccgccagggctacgccacccagatcgccggcccctggcacctcggcaagctcgagatcgacttcggcgagtgccccggcaccaccgtcaccatccaggaggactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcaccgccggccagggcacctccgagaccttctccatgggcctcctctgcctcaccctcttcgtcgaggagtgcctccgccgccgcgtcacccgcaagcacatgatcctcgtcgtcaccatcaccttctgcgccatcatcctcggcggcctcacctggatggacctcctccgcgccctcatcatgctcggcgacaccatgtccggccgcatcggcggccagatccacctcgccatcatggccgtcttcaagatgtcccccggctacgtcctcggcgtcttcctccgcaagctcacctcccgcgagaccgccctcatggtcatcggcatggccatgaccaccgtcttctccatcccccacgacctcatggagctcatcgacggcatctccctcggcctcatcctcctcaagatcgtcacccacttcgacgacacccaggtcggcaccctcgccctctccctcaccttcatccgctccaccacccccctcgtcatggcctggcgcaccatcatggccgtcttcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccgtcaccatggccctctggtacatctggcaggtcaagacccagcgctccggcgccctctgggacgtcccctcccccgtcgccacccagaaggccaccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaacaagaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctgctccgtcgccgcccgcggctacatctccacccgcgtcgagatgggcgaggccgccgccatcttcatgaccgccaccccccccggctccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagcgcgtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgccccaagtggctcgacgcccgcgtctacgccgaccccatggccctcaaggacttcaaggagttcgcctccggccgcaagtccatcaccctcgacatcctcaccgagatcgccaccctccccacctacctctcctccaaggccaagctcgccctcgacaacatcgtcatgctccacaccaccgagaagggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatcggcctcatcgccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgtcggccagctcctcctcatgcgcaccacctgggccctctgcgaggtcctcaccctcgccaccggccccatcatgaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctccgcgacggctccaagatcaagcacgccgtctcccgcggctcctccaagatccgctggatcgtcgagcgcggcatgatcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgccgccacggcggctccctcgtccgctgccccctctcccgcaactccacccacgagatgtactgggtctccggcgcctccggcaacatcgtctcctccgtcaacaccatctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccgcgaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatgatcatgaccaccaccgccaactggctctgggccctcctcggcaagaagaagtccccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttctcccgcgagaactcctggtccggcgtcgagggcgagggcctccaccgcctcggctacatcctcgaggacatcgacaagaaggacggcgacctcatctacgccgacgacaccgccggctgggacacccgcatcaccgaggacgacctcctcaacgaggagctcatcaccgagcagatggccccccaccacaagaccctcgccaaggccatcttcaagctcacctaccagaacaaggtcgtcaaggtcctccgccccacccccaagggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcgaggagcgcgtcgagaagtggctcaaggagtgcggcgtcgaccgcctcaagcgcatggccatctccggcgacgactgcgtcgtcaagcccctcgacgagcgcttctccacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccatctcccgcaccacctggtccatccacgcccaccaccagtggatgaccaccgaggacatgctcaaggtctggaaccgcgtctggatcgaggacaaccccaacatgaccgacaagacccccatccactcctgggaggacatcccctacctcggcaagcgcgaggacctctggtgcggctccctcatcggcctctcctcccgcgccacctgggccaagaacatccacaccgccatctcccaggtccgcaacctcatcggcaaggaggagtacgtcgactacatgcccgtcatgaagcgctactccgccccctccgagtccgagggcgtcctctga

SEQ ID NO: 13123 - RNA, 9867 nt, synthetic construct
  misc_feature 1..9867: note = derived and/or modified CDS sequence (opt2) from DENV-4__KC762696__SS-prME
  source 1..9867: mol_type = other RNA
tccaccatgaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggcctccatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttcctctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccgccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcatcatctcctccacccccttcgccgagaacaccaactccgtcaccaacatcgagctcgagccccccttcggcgactcctacatcgtcatcggcgtcggcgactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggaacggcaaggagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgtcaacgacctcaagtactcctggaagacctggggcaaggccaagatcttcacccccgaggcccgcaactccaccttcctcatcgacggccccgacacctccgagtgccccaacgagcgccgcgcctggaacttcttcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagaaggcctccctcatcgaggtcaagacctgcctctggcccaagacccacaccctctggtccaacggcgtcctcgagtcccagatgctcatcccccgctcctacgccggccccttctcccagcacaactaccgccagggctacgccacccagaccgccggcccctggcacctcggcaagctcgagatcgacttcggcgagtgccccggcaccaccgtcaccatccaggaggactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcaccgccggccagggcacctccgagaccttctccatgggcctcctctgcctcaccctcttcgtcgaggagtgcctccgccgccgcgtcacccgcaagcacatgatcctcgtcgtcgtcatcaccttctgcgccatcatcctcggcggcctcacctggatggacctcctccgcgccctcatcatgctcggcgacaccatgtccggccgcatcggcggccagatccacctcgccatcatggccgtcttcaagatgtcccccggctacgtcctcggcgtcttcctccgcaagctcacctcccgcgagaccgccctcatggtcatcggcatggccatgaccaccgtcttctccatcccccacgacctcatggagctcatcgacggcatctccctcggcctcatcatcctcaagatcgtcacccacttcgacaacacccaggtcggcaccctcgccctctccctcaccttcatccgctccaccacccccctcgtcatggcctggcgcaccatcatggccgtcttcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccgtcaccatggccctctggtacgtctggcaggtcaagacccagcgctccggcgccctctgggacgtcccctcccccgccgccacccagaaggccaccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaacaagaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctgctccgtcgccgcccgcggctacatctccacccgcgtcgagatgggcgaggccgccgccatcttcatgaccgccaccccccccggctccatcgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagcgcgtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgccccaagtggctcgacgcccgcgtctacgccgaccccatggccctcaaggacttcaaggagttcgcctccggccgcaagtccatcaccctcgacatcctcaccgagatcgccaccctccccacctacctctcctccaaggccaagctcgccctcgacaacatcgtcatgctccacaccaccgagaagggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcgccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgtcggccagctcctcctcatgcgcaccacctgggccctctgcgaggtcctcaccctcgccaccggccccgtcatgaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctccgcgacggctccaagatcaagtacgccgtctcccgcggctcctccaagatccgctggatcgtcgagcgcggcatgatcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgccgccacggcggctccctcgtccgctgccccctctcccgcaactccacccacgagatgtactgggtctccggcgcctccggcaacatcgtctcctccgtcaacaccatctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccgcgaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatgatcatgaccaccaccgccaactggctctgggccctcctcggcaagaagaagtccccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttctcccgcgagaactcctggtccggcgtcgagggcgagggcctccaccgcctcggctacatcctcgaggacatcgacaagaaggacggcgacctcatctacgccgacgacaccgccggctgggacacccgcatcaccgaggacgacctcctcaacgaggagctcatcaccgagcagatggccccccaccacaagaccctcgccaaggccatcttcaagctcacctaccagaacaaggtcgtcaaggtcctccgccccacccccaagggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctcaaggagtgcggcgtcgaccgcctcaagcgcatggccatctccggcgacgactgcgtcgtcaagcccctcgacgagcgcttctccacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccccgacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgaccgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgccatgaagcgctactccgcccccttcgagtccgagggcgtcctctga

SEQ ID NO: 13124 - RNA, 9867 nt, synthetic construct
  misc_feature 1..9867: note = derived and/or modified CDS sequence (opt2) from DENV-4__KC762697__SS-prME
  source 1..9867: mol_type = other RNA
tccaccatgaccctcctctgcctcatccccaccgccatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggcctccatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttcctctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccgccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcatcatctcctccacccccttcgccgagaacaccaactccgtcaccaacatcgagctcgagccccccttcggcgactcctacatcgtcatcggcgtcggcgactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcctcctcgtcctctggatcggcaccaactcccgcaacacctccatggccatgacctgcatcgccgtcggcggcatcaccctcttcctcggcttcaccgtccaggccgacatgggctgcgtcgtctcctggaacggcaaggagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgtcctcaccccccccgtcaacgacctcaagtactcctggaagacctggggcaaggccaagatcttcacccccgaggcccgcaactccaccttcctcatcgacggccccgacacctccgagtgccccaacgagcgccgcgcctggaacttcttcgaggtcgaggactacggcttcggcatgttctccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagaaggcctccctcatcgaggtcaagacctgcctctggcccaagacccacaccctctggtccaacggcgtcctcgagtcccagatgctcatcccccgctcctacgccggccccttctcccagcacaactaccgccagggctacgccacccagatcgccggcccctggcacctcggcaagctcgagatcgacttcggcgagtgccccggcaccaccgtcaccatccaggaggactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcaccgccggccagggcacctccgagaccttctccatgggcctcctctgcctcaccctcttcgtcgaggagtgcctccgccgccgcgtcacccgcaagcacatgatcctcgtcgtcgccatcaccttctgcgccatcatcctcggcggcctcacctggatggacctcctccgcgccctcatcatgctcggcgacaccatgtccggccgcatcggcggccagatccacctcgccatcatggccgtcttcaagatgtcccccggctacgtcctcggcgtcttcctccgcaagctcacctcccgcgagaccgccctcatggtcatcggcatggccatgaccaccgtcttctccatcccccacgacctcatggagctcatcgacggcatctccctcggcctcatcctcctcaagatcgtcacccacttcgacgacacccaggtcggcaccctcgccctctccctcaccttcatccgctccaccacccccctcgtcatggcctggcgcaccatcatggccgtcttcttcatggtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccgtcaccatggccctctggtacatctggcaggtcaagacccagcgctccggcgccctctgggacgtcccctcccccgccgccacccagaaggccaccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaacaagaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaaggccgagcacaccggccgcgagatcgtcgacctcatgtgccacgccaccttcaccacccgcctcctctcctccacccgcgtccccaactacaacctcatcgtcatggacgaggcccacttcaccgacccctgctccgtcgccgcccgcggctacatctccacccgcgtcgagatgggcgaggccgccgccatcttcatgaccgccaccccccccggctccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagcgcgtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgccccaagtggctcgacgcccgcgtctacgccgaccccatggccctcaaggacttcaaggagttcgcctccggccgcaagtccatcaccctcgacatcctcaccgagatcgccaccctccccacctacctctcctccaaggccaagctcgccctcgacaacatcgtcatgctccacaccaccgagaagggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcgccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggccaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgtcggccagctcctcctcatgcgcaccacctgggccctctgcgaggtcctcaccctcgccaccggccccatcatgaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctccgcgacggctccaagatcaagtacgccgtctcccgcggctcctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgccgccacggcggctccctcgtccgctgccccctctcccgcaactccacccacgagatgtactgggtctccggcgcctccggcaacatcgtctcctccgtcaacaccatctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccgcgaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatgatcatgaccaccaccgccaactggctctgggccctcctcggcaagaagaagtccccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttctcccgcgagaactcctggtccggcgtcgagggcgagggcctccaccgcctcggctacatcctcgaggacatcgacaagaaggacggcgacctcatctacgccgacgacaccgccggctgggacacccgcatcaccgaggacgacctcctcaacgaggagctcatcaccgagcagatggccccccaccacaagaccctcgccaaggccatcttcaagctcacctaccagaacaaggtcgtcaaggtcctccgccccacccccaagggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcgaggagcgcgtcgagaagtggctcaaggagtgcggcgtcgaccgcctcaagcgcatggccatctccggcgacgactgcgtcgtcaagcccctcgacgagcgcttctccacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgaccgacaagacccccatccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgtcatgaagcgctactccgccccctccgagtccgagggcgtcctctga

SEQ ID NO: 13125 - RNA, 9867 nt, synthetic construct
  misc_feature 1..9867: note = derived and/or modified CDS sequence (opt2) from DENV-4__KC762698__SS-prME
  source 1..9867: mol_type = other RNA
tccaccatgaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgtctgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggcctccatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttcctctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccgccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcatcatctcctccacccccttcgccgagaacaccaactccgtcaccaacatcgagctcgagccccccttcggcgactcctacatcgtcatcggcgccggcgactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggaacggcaaggagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgtcaacgacctcaagtactcctggaagacctggggcaaggccaagatcttcacccccgaggcccgcaactccaccttcctcatcgacggccccgacacctccgagtgccccaacgagcgccgcgcctggaacttcttcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagaaggcctccctcatcgaggtcaagacctgcctctggcccaagacccacaccctctggtccaacggcgtcctcgagtcccagatgctcatcccccgctcctacgccggccccttctcccagcacaactaccgccagggctacgccacccagaccgccggcccctggcacctcggcaagctcgagatcgacttcggcgagtgccccggcaccaccgtcaccatccaggaggactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcaccgccggccagggcacctccgagaccttctccatgggcctcctctgcctcaccctcttcgtcgaggagtgcctccgccgccgcgtcacccgcaagcacatgatcctcgtcgtcgtcatcaccttctgcgccatcatcctcggcggcctcacctggatggacctcctccgcgccctcatcatgctcggcgacaccatgtccggccgcatcggcggccagatccacctcgccatcatggccgtcttcaagatgtcccccggctacgtcctcggcgtcttcctccgcaagctcacctcccgcgagaccgccctcatggtcatcggcatggccatgaccaccgtcttctccatcccccacgacctcatggagctcatcgacggcatctccctcggcctcatcctcctcaagatcgtcacccacttcgacaacacccaggtcggcaccctcgccctctccctcaccttcatccgctccaccacccccctcgtcatggcctggcgcaccatcatggccgtcttcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccgtcaccatggccctctggtacgtctggcaggtcaagacccagcgctccggcgccctctgggacgtcccctcccccgccgccacccagaaggccaccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaacaagaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctgctccgtcgccgcccgcggctacatctccacccgcgtcgagatgggcgaggccgccgccatcttcatgaccgccaccccccccggctccatcgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgccccaagtggctcgacgcccgcgtctacgccgaccccatggccctcaaggacttcaaggagttcgcctccggccgcaagtccatcaccctcgacatcctcaccgagatcgccaccctccccacctacctctcctccaaggccaagctcgccctcgacaacatcgtcatgctccacaccaccgagaagggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcgccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaacaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgtcggccagctcctcctcatgcgcaccacctgggccctctgcgaggtcctcaccctcgccaccggccccgtcatgaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctccgcgacggctccaagatcaagtacgccgtctcccgcggctcctccaagatccgctggatcgtcgagcgcggcatgatcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgccgccacggcggctccctcgtccgctgccccctctcccgcaactccacccacgagatgtactgggtctccggcgcctccggcaacatcgtctcctccgtcaacaccatctccaagatgctcctcaaccgcttcaccacccgccaccgcaagcccacctacgagaaggacgtcgacctcggcgccggcacccgctccgtctccaccgagatcgagaagcccgacatgaccatcatcggccgccgcctccagcgcctccgcgaggagcacaaggagacctggcactacgaccacgagaacccctaccgcacctgggcctaccacggctcctacgaggccccctccaccggctccgcctcctccatggtcaacggcatcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatgatcatgaccaccaccgccaactggctctgggccctcctcggcaagaagaagtccccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttctcccgcgagaactcctggtccggcgtcgagggcgagggcctccaccgcctcggctacatcctcgaggacatcgacaagaaggacggcgacctcatctacgccgacgacaccgccggctgggacacccgcatcaccgaggacgacctcctcaacgaggagctcatcaccgagcagatggccccccaccacaagaccctcgccaaggccatcttcaagctcacctaccagaacaaggtcgtcaaggtcctccgccccacccccaagggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctcaaggagtgcggcgtcgaccgcctcgagcgcatggccatctccggcgacgactgcgtcgtcaagcccctcgacgagcgcttctccacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggctcctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgaccgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgccatgaagcgctactccgcccccttcgagtccgagggcgtcctctga

SEQ ID NO: 13126 - RNA, 9867 nt, synthetic construct
  misc_feature 1..9867: note = derived and/or modified CDS sequence (opt2) from DENV-4__KC762699__SS-prME
  source 1..9867: mol_type = other RNA
tccaccatgaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggcctccatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttcctctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccgccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcatcatctcctccacccccttcgccgagaacaccaactccgtcaccaacatcgagctcgagccccccttcggcgactcctacatcgtcatcggcgtcggcgactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggaacggcaaggagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgtcaacgacctcaagtactcctggaagacctggggcaaggccaagatcttcacccccgaggcccgcaactccaccttcctcatcgacggccccgacacctccgagtgccccaacgagcgccgcgcctggaacttcttcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagaaggcctccctcatcgaggtcaagacctgcctctggcccaagacccacaccctctggtccaacggcgtcctcgagtcccagatgctcatcccccgctcctacgccggccccttctcccagcacaactaccgccagggctacgccacccagaccgccggcccctggcacctcggcaagctcgagatcgacttcggcgagtgccccggcaccaccgtcaccatccaggaggactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcaccgccggccagggcacctccgagaccttctccatgggcctcctctgcctcaccctcttcgtcgaggagtgcctccgccgccgcgtcacccgcaagcacatgatcctcgtcgtcgtcatcaccttctgcgccatcatcctcggcggcctcacctggatggacctcctccgcgccctcatcatgctcggcgacaccatgtccggccgcatcggcggccagatccacctcgccatcatggccgtcttcaagatgtcccccggctacgtcctcggcgtcttcctccgcaagctcacctcccgcgagaccgccctcatggtcatcggcatggccatgaccaccgtcttctccatcccccacgagctcatggagctcatcgacggcatctccctcggcctcatcctcctcaagatcgtcacccacttcgacaacacccaggtcggcaccctcgccctctccctcaccttcatccgctccaccacccccctcgtcatggcctggcgcaccatcatggccgtcttcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccgtcaccatggccctctggtacgtctggcaggtcaagacccagcgctccggcgccctctgggacgtcccctcccccgccgccacccagaaggccaccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaacaagaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctgctccgtcgccgcccgcggctacatctccacccgcgtcgagatgggcgaggccgccgccatcttcatgaccgccaccccccccggctccatcgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagcgcgtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgccccaagtggctcgacgcccgcgtctacgccgaccccatggccctcaaggacttcaaggagttcgcctccggccgcaagtccatcaccctcgacatcctcaccgagatcgccaccctccccacctacctctcctccaaggccaagctcgccctcgacaacatcgtcatgctccacaccaccgagaagggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcgccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgtcggccagctcctcctcatgcgcaccacctgggccctctgcgaggtcctcaccctcgccaccggccccgtcatgaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctccgcgacggctccaagatcaagtacgccgtctcccgcggctcctccaagatccgctggatcgtcgagcgcggcatgatcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgccgccacggcggctccctcgtccgctgccccctctcccgcaactccacccacgagatgtactgggtctccggcgcctccggcaacatcgtctcctccgtcaacaccatctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccgcgaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatgatcatgaccaccaccgccaactggctctgggccctcctcggcaagaagaagtccccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttctcccgcgagaactcctggtccggcgtcgagggcgagggcctccaccgcctcggctacatcctcgaggacatcgacaagaaggacggcgacctcatctacgccgacgacaccgccggctgggacacccgcatcaccgaggacgacctcctcaacgaggagctcatcaccgagcagatggccccccaccacaagaccctcgccaaggccatcttcaagctcacctaccagaacaaggtcgtcaaggtcctccgccccacccccaagggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctcaaggagtgcggcgtcgaccgcctcaagcgcatggccatctccggcgacgactgcgtcgtcaagcccctcgacgagcgcttctccacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgaccgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgccatgaagcgctactccgcccccttcgagtccgagggcgtcctctga

SEQ ID NO: 13127 - RNA, 9867 nt, synthetic construct
  misc_feature 1..9867: note = derived and/or modified CDS sequence (opt2) from DENV-4__JQ915085__SS-prME
  source 1..9867: mol_type = other RNA
tccaccatgaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggcctccatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttcctctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccgccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcatcatctcctccacccccttcgccgagaacaccaactccgtcaccaacatcgagctcgagccccccttcggcgactcctacatcgtcatcggcgtcggcgactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatcatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggaacggcaaggagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgtcaacgacctcaagtactcctggaagacctggggcaaggccaagatcttcacccccgaggcccgcaactccaccttcctcatcgacggccccgacacctccgagtgccccaacgagcgccgcgcctggaacttcttcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagaaggcctccctcatcgaggtcaagacctgcctctggcccaagacccacaccctctggtccaacggcgtcctcgagtcccagatgctcatcccccgctcctacgccggccccttctcccagcacaactaccgccagggctacgccacccagaccgccggcccctggcacctcggcaagctcgagatcgacttcggcgagtgccccggcaccaccgtcaccatccaggaggactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcaccgccggccagggcacctccgagaccttctccatgggcctcctctgcctcaccctcttcgtcgaggagtgcctccgccgccgcgtcacccgcaagcacatgatcctcgtcgtcgtcatcaccttctgcgccatcatcctcggcggcctcacctgggtcgacctcctccgcgccctcatcatgctcggcgacaccatgtccggccgcatcggcggccagatccacctcgccatcatggccgtcttcaagatgtcccccggctacgtcctcggcgtcttcctccgcaagctcacctcccgcgagaccgccctcatggtcatcggcatggccatgaccaccgtcttctccatcccccgcgacctcatggagctcatcgacggcatctccctcggcctcatcctcctcaagatcgtcacccacttcgacaacacccaggtcggcaccctcgccctctccctcaccttcatccgctccaccacccccctcgtcatggcctggcgcaccatcatggtcgtcttcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccgtcaccatggccctctggtacatctggcaggtcaagacccagcgctccggcgccctctgggacgtcccctcccccgccgccatccagaaggccaccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaacaagaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctgctccgtcgccgcccgcggctacatctccacccgcgtcgagatgggcgaggccgccgccatcttcatgaccgccaccccccccggctccatcgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgccccaagtggctcgacgcccgcgtctacgccgaccccatggccctcaaggacttcaaggagttcgcctccggccgcaagtccatcaccctcgacatcctcaccgagatcgccaccctccccacctacctctcctccaaggccaagctcgccctcgacaacatcgtcatgctccacaccgccgagaagggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcgccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgtcggccagctcctcctcatgcgcaccacctgggccctctgcgaggtcctcaccctcgccaccggccccatcatgaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctccgcgacggctccaagatcaagcacgccgtctcccgcggctcctccaagatccgctggatcgtcgagcgcggcatgatcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgccgccacggcggctccctcgtccgctgccccctctcccgcaactccacccacgagatgtactgggtctccggcgcctccggcaacatcgtctcctccgtcaacaccatctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccgcgaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatgatcatgaccaccaccgccaactggctctgggccctcctcggcaagaagaagtccccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttctcccgcgagaactcctggtccggcgtcgagggcgagggcctccaccgcctcggctacatcctcgaggacatcgacaagaaggacggcgacctcatctacgccgacgacaccgccggctgggacacccgcatcaccgaggacgacctcctcaacgaggagctcatcaccgagcagatggccccccaccacaagaccctcgccaaggccatcttcaagctcacctaccagaacaaggtcgtcaaggtcctccgccccacccccaagggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctcaaggagtgcggcgtcgaccgcctcaagcgcatggccatctccggcgacgactgcgtcgtcaagcccctcgacgagcgcttctccacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgaccgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgccatgaagcgctactccgcccccttcgagtccgagggcgtcctctga

SEQ ID NO: 13128 - RNA, 9867 nt, synthetic construct
  misc_feature 1..9867: note = derived and/or modified CDS sequence (opt2) from DENV-4__JQ915088__SS-prME
  source 1..9867: mol_type = other RNA
tccaccatgaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcatcgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggcctccatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttcctctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccgccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaagatccccatcgagatccgcgacgtcaacaaggagaaggtcgtcggccgcatcatctcctccacccccttcgccgagaacaccaactccgtcatcaacatcgagctcgagccccccttcggcgactcctacatcgtcatcggcgtcggcgactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggaacggcaaggagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgtcaacgacctcaagtactcctggaagacctggggcaaggccaagatctccacccccgaggcccgcaactccaccttcctcatcgacggccccgacacctccgagtgccccaacgagcgccgcgcctggaacttcttcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagaaggcctccctcatcgaggtcaagacctgcctctggcccaagacccacaccctctggtccaacggcgtcctcgagtcccagatgctcatcccccgctcctacgccggccccttctcccagcacaactaccgccagggctacgccacccagaccgccggcccctggcacctcggcaagctcgagatcgacttcggcgagtgccccggcaccaccgtcaagatccaggaggactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcaccgccggccagggcacctccgagaccttctccatgggcctcctctgcctcaccctcttcgtcgaggagtgcctccgccgccgcgtcacccgcaagcacatgatcctcgtcgtcgtcatcaccttctgcgccatcatcctcggcggcctcacctggatggacctcctccgcgccctcatcatgctcggcgacaccatgtccggccgcatcggcggccagatccacctcgccatcatgaccgtcttcaagatgtcccccggctacgtcctcggcgtcttcctccgcaagctcacctcccgcgagaccgccctcatggtcatcggcatggccatgaccaccgtcttctccatcccccacgacctcatggagctcatcgacggcatctccctcggcctcatcctcctcaagatcgtcacccacttcgacaacacccaggtcggcaccctcgccctctccctcaccttcatgcgctccaccacccccctcgtcatggcctggcgcaccatcatggccgtcttcttcgtcatcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccgtcaccatggccctctggtacatctggcaggtcaagacccagcgctccggcgccctctgggacgtcccctcccccgccgccacccagaaggccaccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaacccccgccacgtccagaccaagcccggcctcttcaagaccctcaccggcgagatcggcgccgtcaccctcgacttcaagcccggcacctccggctcccccatcatcaacaagaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctgctccgtcgccgcccgcggctacatctccacccgcgtcgagatgggcgaggccgccgccatcttcatgaccgccaccccccccggctccatcgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagcgcgtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgccccaagtggctcgacgcccgcgtctacgccgaccccatggccctcaaggacttcaaggagttcgcctccggccgcaagtccaccaccctcgacatcctcaccgagatcgccaccctccccacctacctctcctccaaggccaagctcgccctcgacaacatcgtcatgctccacaccaccgagaagggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcgccatggccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcatccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgtcggccagctcctcctcatgcgcaccacctgggccctctgcgaggtcctcaccctcgccaccggccccatcatgaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctccgcgacggctccaagatcaagcacgccgtctcccgcggctcctccaagatccgctggatcgtcgagcgcggcatgatcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcatcctcaagatggtcgagccctggctctcctccaagcccgagttctgcatcaaggtcctcaacccctacatgcccaccgtcatcgaggagctcgagaagctccagcgccgccacggcggctccctcgtccgctgccccctctcccgcaactccacccacgagatgtactgggtctccggcgcctccggcaacatcgtctcctccgtcaacaccatctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagctcggcacccgcatgatcatgaccaccaccgccaactggctctgggccctcctcggcaagaagaagtccccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttctcccgcgagaactcctggtccggcgtcgagggcgagggcctccaccgcctcggctacatcctcgaggacatcgacaagaaggacggcgacctcatctacgccgacgacaccgccggctgggacacccgcatcaccgaggacgacctcctcaacgaggagctcatcaccgagcagatggccccccaccacaagaccctcgccaaggccatcttcaagctcacctaccagaacaaggtcgtcaaggtcctccgccccacccccaagggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctcaaggagtgcggcgtcgaccgcctcaagcgcatggccatctccggcgacgactgcgtcgtcaagcccctcgacgagcgcttctccacctccctcctcttcctcaacgacatgggcaaggtccgcaaggacgtcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccagcaccagtggatgaccaccgaggacatgctcaaggtctggaaccgcgtctggatcgaggacaaccccaacatgaccgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgtcatgaagcgctactcctccccctccgagtccgagggcgtcctctga

SEQ ID NO: 13129 - RNA, 9867 nt, synthetic construct
  misc_feature 1..9867: note = derived and/or modified CDS sequence (opt2) from DENV-4__JQ915086__SS-prME
  source 1..9867: mol_type = other RNA
tccaccatgaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggcctccatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttcctctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccgccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaagatccccatcgagatccgcgacgtcaacaaggagaaggtcgtcggccgcatcatctcctccacccccttcgccgagaacaccaactccgtcatcaacatcgagctcgagccccccttcggcgactcctacatcgtcatcggcgtcggcgactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggaacggcaaggagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgtcctcaccccccccgtcaacgacctcaagtactcctggaagacctggggcaaggccaagatcttcacccccgaggcccgcaactccaccttcctcatcgacggccccgacacctccgagtgccccaacgagcgccgcgcctggaacttcttcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagaaggcctccctcatcgaggtcaagacctgcctctggcccaagacccacaccctctggtccaacggcgtcctcgagtcccagatgctcatcccccgctcctacgccggccccttctcccagcacaactaccgccagggctacgccacccagaccgccggcccctggcacctcggcaagctcgagatcgacttcggcgagtgccccggcaccaccgtcaagatccaggaggactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcaccgccggccagggcacctccgagaccttctccatgggcctcctctgcctcaccctcttcgtcgaggagtgcctccgccgccgcgtcacccgcaagcacatgatcctcgtcgtcgtcatcaccttctgcgccatcatcctcggcggcctcacctggatggacctcctccgcgccctcatcatgctcggcgacaccatgtccggccgcatcggcggccagatccacctcgccatcatgaccgtcttcaagatgtcccccggctacgtcctcggcgtcttcctccgcaagctcacctcccgcgagaccgccctcatggtcatcggcatggccatgaccaccgtcttctccatcccccacgacctcatggagctcatcgacggcatctccctcggcctcatcctcctcaagatcgtcacccacttcgacaacacccaggtcggcaccctcgccctctccctcaccttcatccgctccaccacccccctcgtcatggcctggcgcaccatcatggccgtcttcttcgtcatcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccgtcaccatggccctctggtacatctggcaggtcaagacccagcgctccggcgccctctgggacgtcccctcccccgccgccacccagaaggccaccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaacccccgccacgtccagaccaagcccggcctcttcaagaccctcaccggcgagatcggcgccgtcaccctcgacttcaagcccggcacctccggctcccccatcatcaacaagaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctgctccgtcgccgcccgcggctacatctccacccgcgtcgagatgggcgaggccgccgccatcttcatgaccgccaccccccccggctccatcgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagcgcgtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgccccaagtggctcgacgcccgcgtctacgccgaccccatggccctcaaggacttcaaggagttcgcctccggccgcaagtccaccaccctcgacatcctcaccgagatcgccaccctccccacctacctctcctccaaggccaagctcgccctcgacaacatcgtcatgctccacaccaccgagaagggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcgccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcatccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgtcggccagctcctcctcatgcgcaccacctgggccctctgcgaggtcctcaccctcgccaccggccccatcatgaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctccgcgacggctccaagatcaagcacgccgtctcccgcggctcctccaagatccgctggatcgtcgagcgcggcatgatcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcatcctcaagatggtcgagccctggctctcctccaagcccgagttctgcatcaaggtcctcaacccctacatgcccaccgtcatcgaggagctcgagaagctccagcgccgccacggcggctccctcgtccgctgccccctctcccgcaactccacccacgagatgtactgggtctccggcgcctccggcaacatcgtctcctccgtcaacaccatctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagctcggcacccgcatgatcatgaccaccaccgccaactggctctgggccctcctcggcaagaagaagtccccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttctcccgcgagaactcctggtccggcgtcgagggcgagggcctccaccgcctcggctacatcctcgaggacatcgacaagaaggacggcgacctcatctacgccgacgacaccgccggctgggacacccgcatcaccgaggacgacctcctcaacgaggagctcatcaccgagcagatggccccccaccacaagaccctcgccaaggccatcttcaagctcacctaccagaacaaggtcgtcaaggtcctccgccccacccccaagggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctcaaggagtgcggcgtcgaccgcctcaagcgcatggccatctccggcgacgactgcgtcgtcaagcccctcgacgagcgcttctccacctccctcctcttcctcaacgacatgggcaaggtccgcaaggacgtcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccagcaccagtggatgaccaccgaggacatgctcaaggtctggaaccgcgtctggatcgaggacaaccccaacatgaccgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgtcatgaagcgctactccgccccctccgagtccgagggcgtcctctga

SEQ ID NO: 13130 - RNA, 9867 nt, synthetic construct
  misc_feature 1..9867: note = derived and/or modified CDS sequence (opt2) from DENV-4__JQ915087__SS-prME
  source 1..9867: mol_type = other RNA
tccaccatgaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcatcgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggcctccatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttcctctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccgccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaagatccccatcgagatccgcgacgtcaacaaggagaaggtcgtcggccgcatcatctcctccacccccttcgccgagaacaccaactccgtcatcaacatcgagctcgagccccccttcggcgactcctacatcgtcatcggcgtcggcgactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggaacggcaaggagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgtcaacgacctcaagtactcctggaagacctggggcaaggccaagatcttcacccccgaggcccgcaactccaccttcctcatcgacggccccgacacctccgagtgccccaacgagcgccgcgcctggaacttcttcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagaaggcctccctcatcgaggtcaagacctgcctctggcccaagacccacaccctctggtccaacggcgtcctcgagtcccagatgctcatcccccgctcctacgccggccccttctcccagcacaactaccgccagggctacgccacccagaccgccggcccctggcacctcggcaagctcgagatcgacttcggcgagtgccccggcaccaccgtcaagatccaggaggactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcaccgccggccagggcacctccgagaccttctccatgggcctcctctgcctcaccctcttcgtcgaggagtgcctccgccgccgcgtcacccgcaagcacatgatcctcgtcgtcgtcatcaccttctgcgccatcatcctcggcggcctcacctggatggacctcctccgcgccctcatcatgctcggcgacaccatgtccggccgcatcggcggccagatccacctcgccatcatgaccgtcttcaagatgtcccccggctacgtcctcggcgtcttcctccgcaagctcacctcccgcgagaccgccctcatggtcatcggcatggccatgaccaccgtcttctccatcccccacgacctcatggagctcatcgacggcatctccctcggcctcatcctcctcaagatcgtcacccacttcgacaacacccaggtcggcaccctcgccctctccctcaccttcatccgctccaccacccccctcgtcatggcctggcgcaccatcatggccgtcttcttcgtcatcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccgtcaccatggccctctggtacatctggcaggtcaagacccagcgctccggcgccctctgggacgtcccctcccccgccgccacccagaaggccaccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaacccccgccacgtccagaccaagcccggcctcttcaagaccctcaccggcgagatcggcgccgtcaccctcgacttcaagcccggcacctccggctcccccatcatcaacaagaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctgctccgtcgccgcccgcggctacatctccacccgcgtcgagatgggcgaggccgccgccatcttcatgaccgccaccccccccggctccatcgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagcgcgtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgccccaagtggctcgacgcccgcgtctacgccgaccccatggccctcaaggacttcaaggagttcgcctccggccgcaagtccaccaccctcgacatcctcaccgagatcgccaccctccccacctacctctcctccaaggccaagctcgccctcgacaacatcgtcatgctccacaccaccgagaagggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcgccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcatccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgtcggccagctcctcctcatgcgcaccacctgggccctctgcgaggtcctcaccctcgccaccggccccatcatgaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctccgcgacggctccaagatcaagcacgccgtctcccgcggctcctccaagatccgctggatcgtcgagcgcggcatgatcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcatcctcaagatggtcgagccctggctctcctccaagcccgagttctgcatcaaggtcctcaacccctacatgcccaccgtcatcgaggagctcgagaagctccagcgccgccacggcggctccctcgtccgctgccccctctcccgcaactccacccacgagatgtactgggtctccggcgcctccggcaacatcgtctcctccgtcaacaccatctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagctcggcacccgcatgatcatgaccaccaccgccaactggctctgggccctcctcggcaagaagaagtccccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttctcccgcgagaactcctggtccggcgtcgagggcgagggcctccactccctcggctacatcctcgaggacatcgacaagaaggacggcgacctcatctacgccgacgacaccgccggctgggacacccgcatcaccgaggacgacctcctcaacgaggagctcatcaccgagcagatggccccccaccacaagaccctcgccaaggccatcttcaagctcacctaccagaacaaggtcgtcaaggtcctccgccccacccccaagggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctcaaggagtgcggcgtcgaccgcctcaagcgcatggccatctccggcgacgactgcgtcgtcaagcccctcgacgagcgcttctccacctccctcctcttcctcaacgacatgggcaaggtccgcaaggacgtcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccagcaccagtggatgaccaccgaggacatgctcaaggtctggaaccgcgtctggatcgaggacaaccccaacatgaccgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgtcatgaagcgctactccgccccctccgagtccgagggcgtcctctga

SEQ ID NO: 13131 - RNA, 9867 nt, synthetic construct
  misc_feature 1..9867: note = derived and/or modified CDS sequence (opt2) from DENV-4__JQ915089__SS-prME
  source 1..9867: mol_type = other RNA
tccaccatgaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggcctccatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttcctctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccgccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaagatccccatcgagatccgcgacgtcaacaaggagaaggtcgtcggccgcatcatctcctccacccccttcgccgagaacaccaactccgtcatcaacatcgagctcgagccccccttcggcgactcctacatcgtcatcggcgtcggcgactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggaacggcaaggagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgtcctcaccccccccgtcaacgacctcaagtactcctggaagacctggggcaaggccaagatcttcacccccgaggcccgcaactccaccttcctcatcgacggccccgacacctccgagtgccccaacgagcgccgcgcctggaacttcttcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagaaggcctccctcatcgaggtcaagacctgcctctggcccaagacccacaccctctggtccaacggcgtcctcgagtcccagatgctcatcccccgctcctacgccggccccttctcccagcacaactaccgccagggctacgccacccagaccgccggcccctggcacctcggcaagctcgagatcgacttcggcgagtgccccggcaccaccgtcaagatccaggaggactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcaccgccggccagggcacctccgagaccttctccatgggcctcctctgcctcaccctcttcgtcgaggagtgcctccgccgccgcgtcacccgcaagcacatgatcctcgtcgtcgtcatcaccttctgcgccatcatcctcggcggcctcacctggatggacctcctccgcgccctcatcatgctcggcgacaccatgtccggccgcatcggcggccagatccacctcgccatcatgaccgtcttcaagatgtcccccggctacgtcctcggcgtcttcctccgcaagctcacctcccgcgagaccgccctcatggtcatcggcatggccatgaccaccgtcttctccatcccccacgacctcatggagctcatcgacggcatctccctcggcctcatcctcctcaagatcgtcacccacttcgacaacacccaggtcggcaccctcgccctctccctcaccttcatccgctccaccacccccctcgtcatggcctggcgcaccatcatggccgtcttcttcgtcatcaccctcatccccctctgccgcacctcctgcctccagaagcagtcccactgggtcgagatcaccgccctcatcctcggcgcccaggccctccccgtctacctcatgaccctcatgaagggcgcctcctcccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccgtcaccatggccctctggtacatctggcaggtcaagacccagcgctccggcgccctctgggacgtcccctcccccgccgccacccagaaggccaccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaacccccgccacgtccagaccaagcccggcctcttcaagaccctcaccggcgagatcggcgccgtcaccctcgacttcaagcccggcacctccggctcccccatcatcaacaagaagggcaaggtcatcggcctctacggcaacggcgtcgtcaccaagtccggcgactacgtctccgccatcacccaggccgagcgcatcggcgagcccgactacgagatcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctgctccgtcgccgcccgcggctacatctccacccgcgtcgagatgggcgaggccgccgccatcttcatgaccgccaccccccccggctccatcgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagcgcgtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgccccaagtggctcgacgcccgcgtctacgccgaccccatggccctcaaggacttcaaggagttcgcctccggccgcaagtccaccaccctcgacatcctcaccgagatcgccaccctccccacctacctctcctccaaggccaagctcgccctcgacaacatcgtcatgctccacaccaccgagaagggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcgccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcatccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgtcggccagctcctcctcatgcgcaccacctgggccctctgcgaggtcctcaccctcgccaccggccccatcatgaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctccgcgacggctccaagatcaagcacgccgtctcccgcggctcctccaagatccgctggatcgtcgagcgcggcatgatcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcatcctcaagatggtcgagccctggctctcctccaagcccgagttctgcatcaaggtcctcaacccctacatgcccaccgtcatcgaggagctcgagaagctccagcgccgccacggcggctccctcgtccgctgccccctctcccgcaactccacccacgagatgtactgggtctccggcgcctccggcaacatcgtctcctccgtcaacaccatctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagctcggcacccgcatgatcatgaccaccaccgccaactggctctgggccctcctcggcaagaagaagtccccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttctcccgcgagaactcctggtccggcgtcgagggcgagggcctccaccgcctcggctacatcctcgaggacatcgacaagaaggacggcgacctcatctacgccgacgacaccgccggctgggacacccgcatcaccgaggacgacctcctcaacgaggagctcatcaccgagcagatggccccccaccacaagaccctcgccaaggccatcttcaagctcacctaccagaacaaggtcgtcaaggtcctccgccccacccccaagggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctcaaggagtgcggcgtcgaccgcctcaagcgcatggccatctccggcgacgactgcgtcgtcaagcccctcgacgagcgcttctccacctccctcctcttcctcaacgacatgggcaaggtccgcaaggacgtcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccagcaccagtggatgaccaccgaggacatgctcaaggtctggaaccgcgtctggatcgaggacaaccccaacatgaccgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgtcatgaagcgctactccgccccctccgagtccgagggcgtcctctga

SEQ ID NO: 13132 - RNA, 9867 nt, synthetic construct
  misc_feature 1..9867: note = derived and/or modified CDS sequence (opt2) from DENV-4__JQ915082__SS-prME
  source 1..9867: mol_type = other RNA
tccaccatgaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcatcgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggcctccatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttcctctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccgccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaagatccccatcgagatccgcgacgtcaacaaggagaaggtcgtcggccgcatcatctcctccacccccttcgccgagaacaccaactccgtcatcaacatcgagctcgagccccccttcggcgactcctacatcgtcatcggcgtcggcgactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggaacggcaaggagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgtcaacgacctcaagtactcctggaagacctggggcaaggccaagatcttcacccccgaggcccgcaactccaccttcctcatcgacggccccgacacctccgagtgccccaacgagcgccgcgcctggaacttcttcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagaaggcctccctcatcgaggtcaagacctgcctctggcccaagacccacaccctctggtccaacggcgtcctcgagtcccagatgctcatcccccgctcctacgccggccccttctcccagcacaactaccgccagggctacgccacccagaccgccggcccctggcacctcggcaagctcgagatcgacttcggcgagtgccccggcaccaccgtcaagatccaggaggactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcaccgccggccagggcacctccgagaccttctccatgggcctcctctgcctcaccctcttcgtcgaggagtgcctccgccgccgcgtcacccgcaagcacatgatcctcgtcgtcgtcatcaccttctgcgccatcatcctcggcggcctcacctggatggacctcctccgcgccctcatcatgctcggcgacaccatgtccggccgcatcggcggccagatccacctcgccatcatgaccgtcttcaagatgtcccccggctacgtcctcggcgtcttcctccgcaagctcacctcccgcgagaccgccctcatggtcatcggcatggccatgaccaccgtcttctccatcccccacgacctcatggagctcatcgacggcatctccctcggcctcatcctcctcaagatcgtcacccacttcgacaacacccaggtcggcaccctcgccctctccctcaccttcatccgctccaccacccccctcgtcatggcctggcgcaccatcatggccgtcttcttcgtcatcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccgtcaccatggccctctggtacatctggcaggtcaagacccagcgctccggcgccctctgggacgtcccctcccccgccgccacccagaaggccaccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaacccccgccacgtccagaccaagcccggcctcttcaagaccctcaccggcgagatcggcgccgtcaccctcgacttcaagcccggcacctccggctcccccatcatcaacaagaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctgctccgtcgccgcccgcggctacatctccacccgcgtcgagatgggcgaggccgccgccatcttcatgaccgccaccccccccggctccatcgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagcgcgtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgccccaagtggctcgacgcccgcgtctacgccgaccccatggccctcaaggacttcaaggagttcgcctccggccgcaagtccaccaccctcgacatcctcaccgagatcgccaccctccccacctacctctcctccaaggccaagctcgccctcgacaacatcgtcatgctccacaccaccgagaagggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcgccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacatgtccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcatccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgtcggccagctcctcctcatgcgcaccacctgggccctctgcgaggtcctcaccctcgccaccggccccatcatcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctccgcgacggctccaagatcaagcacgccgtctcccgcggctcctccaagatccgctggatcgtcgagcgcggcatgatcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcatcctcaagatggtcgagccctggctctcctccaagcccgagttctgcatcaaggtcctcaacccctacatgcccaccgtcatcgaggagctcgagaagctccagcgccgccacggcggctccctcgtccgctgccccctctcccgcaactccacccacgagatgtactgggtctccggcgcctccggcaacatcgtctcctccgtcaacaccatctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagctcggcacccgcatgatcatgaccaccaccgccaactggctctgggccctcctcggcaagaagaagtccccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttctcccgcgagaactcctggtccggcgtcgagggcgagggcctccaccgcctcggctacatcctcgaggacatcgacaagaaggacggcgacctcatctacgccgacgacaccgccggctgggacacccgcatcaccgaggacgacctcctcaacgaggagctcatcaccgagcagatggccccccaccacaagaccctcgccaaggccatcttcaagctcacctaccagaacaaggtcgtcaaggtcctccgccccacccccaagggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctcaaggagtgcggcgtcgaccgcctcaagcgcatggccatctccggcgacgactgcgtcgtcaagcccctcgacgagcgcttctccacctccctcctcttcctcaacgacatgggcaaggtccgcaaggacgtcccccagtgggacccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccagcaccagtggatgaccaccgaggacatgctcaaggtctggaaccgcgtctggatcgaggacaaccccaacatgaccgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgtcatgaagcgctactccgccccctccgagtccgagggcgtcctctga

SEQ ID NO: 13133 - RNA, 9867 nt, synthetic construct
  misc_feature 1..9867: note = derived and/or modified CDS sequence (opt2) from DENV-4__JQ915081__SS-prME
  source 1..9867: mol_type = other RNA
tccaccatgaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcatcgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggcctccatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttcctctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccgccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaagatccccatcgagatccgcgacgtcaacaaggagaaggtcgtcggccgcatcatctcctccacccccttcgccgagaacaccaactccgtcatcaacatcgagctcgagccccccttcggcgactcctacatcgtcatcggcgtcggcgactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggaacggcaaggagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgtcaacgacctcaagtactcctggaagacctggggcaaggccaagatcttcacccccgaggcccgcaactccaccttcctcatcgacggccccgacacctccgagtgccccaacgagcgccgcgcctggaacttcttcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagaaggcctccctcatcgaggtcaagacctgcctctggcccaagacccacaccctctggtccaacggcgtcctcgagtcccagatgctcatcccccgctcctacgccggccccttctcccagcacaactaccgccagggctacgccacccagaccgccggcccctggcacctcggcaagctcgagatcgacttcggcgagtgccccggcaccaccgtcaagatccaggaggactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcaccgccggccagggcacctccgagaccttctccatgggcctcctctgcctcaccctcttcgtcgaggagtgcctccgccgccgcgtcacccgcaagcacatgatcctcgtcgtcgtcatcaccttctgcgccatcatcctcggcggcctcacctggatggacctcctccgcgccctcatcatgctcggcgacaccatgtccggccgcatcggcggccagatccacctcgccatcatgaccgtcttcaagatgtcccccggctacgtcctcggcgtcttcctccgcaagctcacctcccgcgagaccgccctcatggtcatcggcatggccatgaccaccgtcttctccatcccccacgacctcatggagctcatcgacggcatctccctcggcctcatcctcctcaagatcgtcacccacttcgacaacacccaggtcggcaccctcgccctctccctcaccttcatccgctccaccacccccctcgtcatggcctggcgcaccatcatggccgtcttcttcgtcatcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccgtcaccatggccctctggtacatctggcaggtcaagacccagcgctccggcgccctctgggacgtcccctcccccgccgccacccagaaggccaccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaacccccgccacgtccagaccaagcccggcctcttcaagaccctcaccggcgagatcggcgccgtcaccctcgacttcaagcccggcacctccggctcccccatcatcaacaagaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctgctccgtcgccgcccgcggctacatctccacccgcgtcgagatgggcgaggccgccgccatcttcatgaccgccaccccccccggctccatcgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagcgcgtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgccccaagtggctcgacgcccgcgtctacgccgaccccatggccctcaaggacttcaaggagttcgcctccggccgcaagtccaccaccctcgacatcctcaccgagatcgccaccctccccacctacctctcctccaaggccaagctcgccctcgacaacatcgtcatgctccacaccaccgagaagggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcgccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacatgtccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcatccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgtcggccagctcctcctcatgcgcaccacctgggccctctgcgaggtcctcaccctcgccaccggccccatcatcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctccgcgacggctccaagatcaagcacgccgtctcccgcggctcctccaagatccgctggatcgtcgagcgcggcatgatcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcatcctcaagatggtcgagccctggctctcctccaagcccgagttctgcatcaaggtcctcaacccctacatgcccaccgtcatcgaggagctcgagaagctccagcgccgccacggcggctccctcgtccgctgccccctctcccgcaactccacccacgagatgtactgggtctccggcgcctccggcaacatcgtctcctccgtcaacaccatctccaagatgctcctcaaccgcttcaccacccgccaccgcaagcccacctacgagaaggacgtcgacctcggcgccggcacccgctccgtctccatcgagaccgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagctcggcacccgcatgatcatgaccaccaccgccaactggctctgggccctcctcggcaagaagaagtccccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttctcccgcgagaactcctggtccggcgtcgagggcgagggcctccaccgcctcggctacatcctcgaggacatcgacaagaaggacggcgacctcatctacgccgacgacaccgccggctgggacacccgcatcaccgaggacgacctcctcaacgaggagctcatcaccgagcagatggccccccaccacaagaccctcgccaaggccatcttcaagctcacctaccagaacaaggtcgtcaaggtcctccgccccacccccaagggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctcaaggagtgcggcgtcgaccgcctcaagcgcatggccatctccggcgacgactgcgtcgtcaagcccctcgacgagcgcttctccacctccctcctcttcctcaacgacatgggcaaggtccgcaaggacgtcccccagtgggacccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccagcaccagtggatgaccaccgaggacatgctcaaggtctggaaccgcgtctggatcgaggacaaccccaacatgaccgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgtcatgaagcgctactccgccccctccgagtccgagggcgtcctctga

SEQ ID NO: 13134 - RNA, 9867 nt, synthetic construct
  misc_feature 1..9867: note = derived and/or modified CDS sequence (opt2) from DENV-4__JQ915084__SS-prME
  source 1..9867: mol_type = other RNA
tccaccatgaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcatcgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggcctccatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttcctctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccgccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaagatccccatcgagatccgcgacgtcaacaaggagaaggtcgtcggccgcatcatctcctccacccccttcgccgagaacaccaactccgtcatcaacatcgagctcgagccccccttcggcgactcctacatcgtcatcggcgtcggcgactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggaacggcaaggagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgtcaacgacctcaagtactcctggaagacctggggcaaggccaagatcttcacccccgaggcccgcaactccaccttcctcatcgacggccccgacacctccgagtgccccaacgagcgccgcgcctggaacttcttcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagaaggcctccctcatcgaggtcaagacctgcctctggcccaagacccacaccctctggtccaacggcgtcctcgagtcccagatgctcatcccccgctcctacgccggccccttctcccagcacaactaccgccagggctacgccacccagaccgccggcccctggcacctcggcaagctcgagatcgacttcggcgagtgccccggcaccaccgtcaagatccaggaggactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcaccgccggccagggcacctccgagaccttctccatgggcctcctctgcctcaccctcttcgtcgaggagtgcctccgccgccgcgtcacccgcaagcacatgatcctcgtcgtcgtcatcaccttctgcgccatcatcctcggcggcctcacctggatggacctcctccgcgccctcatcatgctcggcgacaccatgtccggccgcatcggcggccagatccacctcgccatcatgaccgtcttcaagatgtcccccggctacgtcctcggcgtcttcctccgcaagctcacctcccgcgagaccgccctcatggtcatcggcatggccatgaccaccgtcttctccatcccccacgacctcatggagctcatcgacggcatctccctcggcctcatcctcctcaagatcgtcacccacttcgacaacacccaggtcggcaccctcgccctctccctcaccttcatgcgctccaccacccccctcgtcatggcctggcgcaccatcatggccgtcttcttcgtcatcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccgtcaccatggccctctggtacatctggcaggtcaagacccagcgctccggcgccctctgggacgtcccctcccccgccgccacccagaaggccaccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaacccccgccacgtccagaccaagcccggcctcttcaagaccctcaccggcgagatcggcgccgtcaccctcgacttcaagcccggcacctccggctcccccatcatcaacaagaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctgctccgtcgccgcccgcggctacatctccacccgcgtcgagatgggcgaggccgccgccatcttcatgaccgccaccccccccggctccatcgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagcgcgtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgccccaagtggctcgacgcccgcgtctacgccgaccccatggccctcaaggacttcaaggagttcgcctccggccgcaagtccaccaccctcgacatcctcaccgagatcgccaccctccccacctacctctcctccaaggccaagctcgccctcgacaacatcgtcatgctccacaccaccgagaagggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcgccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcgccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcatccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgtcggccagctcctcctcatgcgcaccacctgggccctctgcgaggtcctcaccctcgccaccggccccatcatgaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctccgcgacggctccaagatcaagcacgccgtctcccgcggctcctccaagatccgctggatcgtcgagcgcggcatgatcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcatcctcaagatggtcgagccctggctctcctccaagcccgagttctgcatcaaggtcctcaacccctacatgcccaccgtcatcgaggagctcgagaagctccagcgccgccacggcggctccctcgtccgctgccccctctcccgcaactccacccacgagatgtactgggtctccggcgcctccggcaacatcgtctcctccgtcaacaccatctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagatcggcacccgcatgatcatgaccaccaccgccaactggctctgggccctcctcggcaagaagaagtccccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttctcccgcgagaactcctggtccggcgtcgagggcgagggcctccaccgcctcggctacatcctcgaggacatcgacaagaaggacggcgacctcatctacgccgacgacaccgccggctgggacacccgcatcaccgaggacgacctcctcaacgaggagctcatcaccgagcagatggccccccaccacaagaccctcgccaaggccatcttcaagctcacctaccagaacaaggtcgtcaaggtcctccgccccacccccaagggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctcaaggagtgcggcgtcgaccgcctcaagcgcatggccatctccggcgacgactgcgtcgtcaagcccctcgacgagcgcttctccacctccctcctcttcctcaacgacatgggcaaggtccgcaaggacgtcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccagcaccagtggatgaccaccgaggacatgctcaaggtctggaaccgcgtctggatcgaggacaaccccaacatgaccgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgtcatgaagcgctactcctccccctccgagtccgagggcgtcctctga

SEQ ID NO: 13135 - RNA, 9867 nt, synthetic construct
  misc_feature 1..9867: note = derived and/or modified CDS sequence (opt2) from DENV-4__KM190936__SS-prME
  source 1..9867: mol_type = other RNA
tccaccatcaccctcctctgcctcatccccaccgtcatggccttctccctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggcctccatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccatgatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccgccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcatcatctcctccacccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggtccggcaaggagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgtctccgacctcaagtactcctggaagacctggggcaaggccaagatcttcacccccgaggcccgcaactccaccttcctcatcgacggccccgacacctccgagtgccccaacgagcgccgcgcctggaactccctcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagaaggcctccctcatcgaggtcaagacctgcctctggcccaagacccacaccctctggtccaacggcgtcctcgagtcccagatgctcatccccaagtcctacgccggccccttctcccagcacaactaccgccagggctacgccacccagaccgtcggcccctggcacctcggcaagctcgagatcgacttcggcgagtgccccggcaccaccgtcaccatccaggaggactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcaccgccggccagggcacctccgagaccttctccatgggcctcctctgcctcaccctcttcgtcgaggagtgcctccgccgccgcgtcacccgcaagcacatgatcctcgtcgtcgtcatcaccctctgcgccatcatcctcggcggcctcacctggatggacctcctccgcgccctcatcatgctcggcgacaccatgtccggccgcatcggcggccagatccacctcgccatcatggccgtcttcaagatgtcccccggctacgtcctcggcgtcttcctccgcaagctcacctcccgcgagaccgccctcatggtcatcggcatggccatgaccaccgtcctctccatcccccacgacctcatggagctcatcgacggcatctccctcggcctcatcctcctcaagatcgtcacccagttcgacaacacccaggtcggcaccctcgccctctccctcaccttcatccgctccaccatgcccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccgtcaccatgaccctctggtacatgtggcaggtcaagacccagcgctccggcgccctctgggacgtcccctcccccgccgccacccagaaggccgccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgcccccgctggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcaccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagcacgccgtctcccgcggctcctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgcaagcacggcggcaacctcgtccgctgccccctctcccgcaactccacccacgagatgtactgggtctccggcgcctccggcaacatcgtctcctccgtcaacaccacctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatggtcatgaccaccaccgccaactggctctgggccctcctcggcaagaagaagaacccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggagatcgacaagaaggacggcgacctcatgtacgccgacgacaccgccggctgggacacccgcatcaccgaggacgacctccagaacgaggagctcatcaccgagcagatggccccccaccacaagatcctcgccaaggccatcttcaagctcacctaccagaacaaggtcgtcaaggtcctccgccccaccccccgcggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctcaaggagtgcggcgtcgaccgcctcaagcgcatggccatctccggcgacgactgcgtcgtcaagcccctcgacgagcgcttcggcacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgaccgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgtcatgaagcgctactccgccccctccgagtccgagggcgtcctctga

SEQ ID NO: 13136 - RNA, 9867 nt, synthetic construct
  misc_feature 1..9867: note = derived and/or modified CDS sequence (opt2) from DENV-4__JQ915090__SS-prME
  source 1..9867: mol_type = other RNA
tccaccatgaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcatcgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcgccaagaccaccgccaaggaggtcgccctcctccgcacctactgcatcgaggcctccatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttcctctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccgccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaagatccccatcgagatccgcgacgtcaacaaggagaaggtcgtcggccgcatcatctcctccacccccttcgccgagaacaccaactccgtcatcaacatcgagctcgagccccccttcggcgactcctacatcgtcatcggcgtcggcgactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggaacggcaaggagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgtcaacgacctcaagtactcctggaagacctggggcaaggccaagatcttcacccccgaggcccgcaactccaccttcctcatcgacggccccgacacctccgagtgccccaacgagcgccgcgcctggaacttcttcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagaaggcctccctcatcgaggtcaagacctgcctctggcccaagacccacaccctctggtccaacggcgtcctcgagtcccagatgctcatcccccgctcctacgccggccccttctcccagcacaactaccgccagggctacgccacccagaccgccggcccctggcacctcggcaagctcgagatcgacttcggcgagtgccccggcaccaccgtcaagatccaggaggactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcaccgccggccagggcacctccgagaccttctccatgggcctcctctgcctcaccctcttcgtcgaggagtgcctccgccgccgcgtcacccgcaagcacatgatcctcgtcgtcgtcatcaccttctgcgccatcatcctcggcggcctcacctggatggacctcctccgcgccctcatcatgctcggcgacaccatgtccggccgcatcggcggccagatccacctcgccatcatgaccgtcttcaagatgtcccccggctacgtcctcggcgtcttcctccgcaagctcacctcccgcgagaccgccctcatggtcatcggcatggccatgaccaccgtcttctccatcccccacgacctcatggagctcatcgacggcatctccctcggcctcatcctcctcaagatcgtcacccacttcgacaacacccaggtcggcaccctcgccctctccctcaccttcatgcgctccaccacccccctcgtcatggcctggcgcaccatcatggccgtcttcttcgtcatcaccctcatccccctctgccgcacctcctgcctccagaagcagtcccactgggtcgagatgaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccgtcaccatggccctctggtacatctggcaggtcaagacccagcgctccggcgccctctgggacgtcccctcccccgccgccacccagaaggccaccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgctccgacatgatctcctacggcggcggctggcgcctcggcgacaagtgggacaaggaggaggacgtccaggtcctcgccatcgagcccggcaagaacccccgccacgtccagaccaagcccggcctcttcaagaccctcaccggcgagatcggcgccgtcaccctcgacttcaagcccggcacctccggctcccccatcatcaacaagaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctgctccgtcgccgcccgcggctacatctccacccgcgtcgagatgggcgaggccgccgccatcttcatgaccgccaccccccccggctccatcgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagcgcgtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgccccaagtggctcgacgcccgcgtctacgccgaccccatggccctcaaggacttcaaggagttcgcctccggccgcaagtccaccaccctcgacatcctcaccgagatcgccaccctccccacctacctctcctccaaggccaagctcgccctcgacaacatcgtcatgctccacaccaccgagaagggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcgccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacatgtccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcatccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgtcggccagctcctcctcatgcgcaccacctgggccctctgcgaggtcctcaccctcgccaccggccccatcatgaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctccgcgacggctccaagatcaagcacgccgtctcccgcggctcctccaagatccgctggatcgtcgagcgcggcatgatcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcatcctcaagatggtcgagccctggctctcctccaagcccgagttctgcatcaaggtcctcaacccctacatgcccaccgtcatcgaggagctcgagaagctccagcgccgccacggcggctccctcgtccgctgccccctctcccgcaactccacccacgagatgtactgggtctccggcgcctccggcaacatcgtctcctccgtcaacaccatctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagctcggcacccgcatgatcatgaccaccaccgccaactggctctgggccctcctcggcaagaagaagtccccccgcctctgcacccgcgaggagttcatctccaaggtccgctccaacgccgccatcggcgccgtcttccaggaggagcagggctggacctccgccatcgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttctcccgcgagaactcctggtccggcgtcgagggcgagggcctccaccgcctcggctacatcctcgaggacatcgacaagaaggacggcgacctcatctacgccgacgacaccgccggctgggacacccgcatcaccgaggacgacctcctcaacgaggagctcatcaccgagcagatggccccccaccacaagaccctcgccaaggccatcttcaagctcacctaccagaacaaggtcgtcaaggtcctccgccccacccccaagggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctcaaggagtgcggcgtcgaccgcctcaagcgcatggccatctccggcgacgactgcgtcgtcaagcccctcgacgagcgcttctccacctccctcctcttcctcaacgacatgggcaaggtccgcaaggacgtcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccagcaccagtggatgaccaccgaggacatgctcaaggtctggaaccgcgtctggatcgaggacaaccccaacatgaccgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgtcatgaagcgctactcctccccctccgagtccgagggcgtcctctga

SEQ ID NO: 13137 - RNA, 9867 nt, synthetic construct
  misc_feature 1..9867: note = derived and/or modified CDS sequence (opt2) from DENV-4__KJ160504__SS-prME
  source 1..9867: mol_type = other RNA
tccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggcctccatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccgccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctcctccacccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggtccggccgcgagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgtctccgacctcaagtactcctggaagacctggggcaaggccaagatcttcacccccgaggcccgcaactccaccttcctcatcgacggccccgacacctccgagtgccccaacgagcgccgcgcctggaactccctcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagaaggcctccctcatcgaggtcaagacctgcctctggcccaagacccacaccctctggtccaacggcgtcctcgagtcccagatgctcatccccaagtcctacgccggccccttctcccagcacaactaccgccagggctacgccacccagaccgtcggcccctggcacctcggcaagctcgagatcgacttcggcgagtgccccggcaccaccgtcaccatccaggaggactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcaccgccggccagggcacctccgagaccttctccatgggcctcctctgcctcaccctcttcgtcgaggagtgcctccgccgccgcgtcacccgcaagcacatgatcctcgtcgtcgtcatcaccctctgcgccatcatcctcggcggcctcacctggatggacctcctccgcgccctcatcatgctcggcgacaccatgtccggccgcatcggcggccagatccacctcgccatcatggccgtcttcaagatgtcccccggctacgtcctcggcgtcttcctccgcaagctcacctcccgcgagaccgccctcatggtcatcggcatggccatgaccaccgtcctctccatcccccacgacctcatggagctcatcgacggcatctccctcggcctcatcctcctcaagatcgtcacccagttcgacaacacccaggtcggcaccctcgccctctccctcaccttcatccgctccaccatgcccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccatcaccatgaccctctggtacatgtggcaggtcaagacccagcgctccggcgccctctgggacgtcccctcccccgccgccacccagaaggccgccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcggcaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcgtcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgcccccgctggctcgacgcccgcgtctacgccgaccccatggccctcaaggacttcaaggagttcgcctccggccgcaagtccatcaccctcgacatcctcaccgagatcgcctccctccccgcctacctctcctcccgcgccaagctcgccctcgacaacatcgtcatgctccacaccaccgagcgcggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcaccatcgccgtcgcctccggcctcctctggatcgccgagatccagccccagtggatcgccgcctccatcatcctcgagttcttcctcatggtcctcctcatccccgagcccgagaagcagcgcaccccccaggacaaccagctcatctacgtcatcctcaccgtcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccgtcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcttcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagcacgccgtctcccgcggctcctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgcaagcacggcggcaacctcgtccgctgccccctctcccgcaactccacccacgagatgtactgggtctccggcgcctccggcaacatcgtctcctccgtcaacaccacctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatggtcatgaccaccaccgccaactggctctgggccctcctcggcaagaagaagaacccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggagatcgacaagaaggacggcgacctcatgtacgccgacgacaccgccggctgggacacccgcatcaccgaggacgacctccagaacgaggagctcatcaccgagcagatggccccccaccacaagatcctcgccaaggccatcttcaagctcacctaccagaacaaggtcgtcaaggtcctccgccccaccccccgcggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctccgcgagtgcggcgtcgaccgcctcaagcgcatggccatctccggcgacgactgcgtcgtcaagcccctcgacgagcgcttcggcacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgaccgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgtcatgaagcgctactccgccccctccgagtccgagggcgtcctctga

SEQ ID NO: 13138 - RNA, 9867 nt, synthetic construct
  misc_feature 1..9867: note = derived and/or modified CDS sequence (opt2) from DENV-4__GU289913__SS-prME
  source 1..9867: mol_type = other RNA
tccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggcctccatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccatgatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccgccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcatcatctcctccacccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggtccggcaaggagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgtctccgacctcaagtactcctggaagacctggggcaaggccaagatcttcacccccgaggcccgcaactccaccttcctcatcgacggccccgacacctccgagtgccccaacgagcgccgcgcctggaactccctcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagaaggcctccctcatcgaggtcaagacctgcctctggcccaagacccacaccctctggtccaacggcgtcctcgagtcccagatgctcatccccaagtcctacgccggccccttctcccagcacaactaccgccagggctacgccacccagaccgtcggcccctggcacctcggcaagctcgagatcgacttcggcgagtgccccggcaccaccgtcaccatccaggaggactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcaccgccggccagggcacctccgagaccttctccatgggcctcctctgcctcaccctcttcgtcgaggagtgcctccgccgccgcgtcacccgcaagcacatgatcctcgtcgtcgtcatcaccctctgcgccatcatcctcggcggcctcacctggatggacctcctccgcgccctcatcatgctcggcgacaccatgtccggccgcatcggcggccagatccacctcgccatcatggccgtcttcaagatgtcccccggctacgtcctcggcgtcttcctccgcaagctcacctcccgcgagaccgccctcatggtcatcggcatggccatgaccaccgtcctctccatcccccacgacctcatggagctcatcgacggcatctccctcggcctcatcctcctcaagatcgtcacccagttcgacaacacccaggtcggcaccctcgccctctccctcaccttcatccgctccaccatgcccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccgtcaccatgaccctctggtacatgtggcaggtcaagacccagcgctccggcgccctctgggacgtcccctcccccgccgccacccagaaggccgccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgcccccgctggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcaccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctctccgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagcacgccgtctcccgcggctcctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgcaagcacggcggcaacctcgtccgctgccccctctcccgcaactccacccacgagatgtactgggtctccggcgcctccggcaacatcgtctcctccgtcaacaccacctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatggtcatgaccaccaccgccaactggctctgggccctcctcggcaagaagaagaacccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggagatcgacaagaaggacggcgacctcatgtacgccgacgacaccgccggctgggacacccgcatcaccgaggacgacctccagaacgaggagctcatcaccgagcagatggccccccaccacaagatcctcgccaaggccatcttcaagctcacctaccagaacaaggtcgtcaaggtcctccgccccaccccccgcggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctcaaggagtgcggcgtcgaccgcctcaagcgcatggccatctccggcgacgactgcgtcgtcaagcccctcgacgagcgcttcggcacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgaccgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgtcatgaagcgctactccgccccctccgagtccgagggcgtcctctga

SEQ ID NO: 13139 - RNA, 9867 nt, synthetic construct
  misc_feature 1..9867: note = derived and/or modified CDS sequence (opt2) from DENV-4__KJ579243__SS-prME
  source 1..9867: mol_type = other RNA
tccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggccctcatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccaccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctccgccacccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggctgcctcgtcctctggatcggcaccaactcccgcaacacctccatggccatgacctgcatcgccgtcggcggcatcaccctcttcctcggcttcaccgtccaggccgacatgggctgcgtcgtctcctggtccggccgcgagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgcctccggcctcaagtactcctggaagacctggggcaaggccaagatcttcacccccgaggcccgcaactccaccttcctcatcgacggccccgacacctccgagtgccccaacgagcgccgcgcctggaactccttcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagcgcgcctccctcatcgaggtcaagacctgcctctggcccaagacccacaccctctggtccaacggcgtcctcgagtcccagatgctcatccccaagtcctacgccggccccttctcccagcacaactaccgccagggctacgccacccagaccgtcggcccctggcacctcggcaagctcgagatcgacttcggcgagtgccccggcaccaccgtcaccatccaggagaactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcaccgccggccagggcacctccgagaccttctccatgggcctcctctgcctcaccctcttcgtcgaggagtgcctccgccgccgcgtcacccgcaagcacatgatcctcgccgtcgtcatcaccctctgcgccatcatcctcggcggcctcacctggatggacctcctccgcgccctcatcatcctcggcgacaccatgtccggccgcatcggcggccagacccacctcgccatcatggccgtcttcaagatgtcccccggctacgtcctcggcgtcttcctccgcaagctcacctcccgcgagaccgccctcatggtcatcggcatggccatgaccaccaccctctccatcccccacgacctcatggagctcatcgacggcatctccctcggcctcatcctcctcaagatcgtcacccagttcgacaacacccaggtcggcaccctcgccctctccctcaccttcatccgctccaccatgtccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccatcaccatgaccctctggtacatgtggcaggtcaagacccagcgctccggcgccctctgggacgtcccctcccccgccgccacccagaaggccgccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgccccaagtggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcaccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccgccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagcacgccgtctcccgcggctcctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgcaagcacggcggcaacctcgtccgctgccccctctcccgcaactccacccacgagatgtactgggtctccggcgcctccggcaacatcgtctcctccgtcaacaccacctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatggtcatgaccaccaccgccaactggctctgggccctcctcggcaagaagaagaacccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggagatcgacaagaaggacggcgacctcatgtacgccgacgacaccgccggctgggacacccgcatcaccgaggacgacctccagaacgaggagctcatcaccgagcagatggccccccaccacaagatcctcgccaaggccatcttcaagctcacctaccagaacaaggtcgtcaaggtcctccgccccaccccccgcggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctccgcgagtgcggcgtcgaccgcctcaagcgcatggccatctccggcgacgactgcgtcgtcaagcccctcgacgagcgcttcggcacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgatcgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgtcatgaagcgctactccgccccctccgagtccgagggcgtcctctga

SEQ ID NO: 13140 - RNA, 9867 nt, synthetic construct
  misc_feature 1..9867: note = derived and/or modified CDS sequence (opt2) from DENV-4__KJ579246__SS-prME
  source 1..9867: mol_type = other RNA
tccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggccctcatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccaccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctccgccacccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggtccggccgcgagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgcctccgacctcaagtactcctggaagacctggggcaaggccaagatcttcacccccgaggcccgcaactccaccttcctcatcgacggccccgacacctccgagtgccccaacgagcgccgcgcctggaactccttcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagcgcgcctccctcatcgaggtcaagacctgcctctggcccaagacccacaccctctggtccaacggcgtcctcgagtcccagatgctcatccccaagtcctacgccggccccttctcccagcacaactaccgccagggctacgccacccagaccgtcggcccctggcacctcggcaagctcgagatcgacttcggcgagtgccccggcaccaccgtcaccatccaggagaactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcaccgccggccagggcacctccgagaccttctccatgggcctcctctgcctcaccctcttcgtcgaggagtgcctccgccgccgcgtcacccgcaagcacatgatcctcgccgtcgtcatcaccctctgcgccatcatcctcggcggcctcacctggatggacctcctccgcgccctcatcatcctcggcgacaccatgtccggccgcatcggcggccagacccacctcgccatcatggccgtcttcaagatgtcccccggctacgtcctcggcgtcttcctccgcaagctcacctcccgcgagaccgccctcatggtcatcggcatggccatgaccaccaccctctccatcccccacgacctcatggagctcatcgacggcatctccctcggcctcatcctcctcaagatcgtcacccagttcgacaacacccaggtcggcaccctcgccctctccctcaccttcatccgctccaccatgtccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccatcaccatgaccctctggtacatgtggcaggtcaagacccagcgctccggcgccctctgggacgtcccctcccccgccgccacccagaaggccgccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgccccaagtggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcaccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccgccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagcacgccgtctcccgcggctcctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgcaagcacggcggcaacctcgtccgctgccccctctcccgcaactccacccacgagatgtactgggtctccggcgcctccggcaacatcgtctcctccgtcaacaccacctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatggtcatgaccaccaccgccaactggctctgggccctcctcggcaagaagaagaacccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggagatcgacaagaaggacggcgacctcatgtacgccgacgacaccgccggctgggacacccgcatcaccgaggacgacctccagaacgaggagctcatcaccgagcagatggccccccaccacaagatcctcgccaaggccatcttcaagctcacctaccagaacaaggtcgtcaaggtcctccgccccaccccccgcggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctccgcgagtgcggcgtcgaccgcctcaagcgcatggccatctccggcgacgactgcgtcgtcaagcccctcgacgagcgcttcggcacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgatcgacaagacccccatccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgtcatgaagcgctactccgccccctccgagtccgagggcgtcctctga

SEQ ID NO: 13141 - RNA, 9867 nt, synthetic construct
  misc_feature 1..9867: note = derived and/or modified CDS sequence (opt2) from DENV-4__KJ579248__SS-prME
  source 1..9867: mol_type = other RNA
tccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggccctcatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccaccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctccgccacccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggtccggccgcgagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgcctccgacctcaagtactcctggaagacctggggcaaggccaagatcttcacccccgaggcccgcaactccaccttcctcatcgacggccccgacacctccgagtgccccaacgagcgccgcgcctggaactccttcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagcgcgcctccctcatcgaggtcaagacctgcctctggcccaagacccacaccctctggtccaacggcgtcctcgagtcccagatgctcatccccaagtcctacgccggccccttctcccagcacaactaccgccagggctacgccacccagaccgtcggcccctggcacctcggcaagctcgagatcgacttcggcgagtgccccggcaccaccgtcaccatccaggagaactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcaccgccggccagggcacctccgagaccttctccatgggcctcctctgcctcaccctcttcgtcgaggagtgcctccgccgccgcgtcacccgcaagcacatgatcctcgccgtcgtcatcaccctctgcgccatcatcctcggcggcctcacctggatggacctcctccgcgccctcatcatgctcggcgacaccatgtccggccgcgtcggcggccagacccacctcgccatcatcgccgtcttcaagatgtcccccggctacgtcctcggcgtcttcctccgcaagctcacctcccgcgagaccgccctcatggtcatcggcatggccatgaccaccaccctctccatcccccacgacctcatggagctcatcgacggcatctccctcggcctcatcctcctcaagatcgtcacccagttcgacaacacccaggtcggcaccctcgccctctccctcaccttcatccgctccaccatgtccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccatcaccatgaccctctggtacatgtggcaggtcaagacccagcgctccggcgccctctgggacgtcccctcccccgccgccacccagaaggccgccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgccccaagtggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcaccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccgccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagcacgccgtctcccgcggctcctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgcaagcacggcggcaacctcgtccgctgccccctctcccgcaactccacccacgagatgtactgggtctccggcgcctccggcaacatcgtctcctccgtcaacaccacctccaagatgctcctcaaccgcttcaccacccgccaccgcaagcccacctacgagaaggacgtcgacctcggcgccggcacccgctccgtctccaccgagatcgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatggtcatgaccaccaccgccaactggctctgggccctcctcggcaagaagaagaacccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggagatcgacaagaaggacggcgacctcatgtacgccgacgacaccgccggctgggacacccgcatcaccgaggacgacctccagaacgaggagctcatcaccgagcagatggccccccaccacaagatcctcgccaaggccatcttcaagctcacctaccagaacaaggtcgtcaaggtcctccgccccaccccccgcggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctccgcgagtgcggcgtcgaccgcctcaagcgcatggccatctccggcgacgactgcgtcgtcaagcccctcgacgagcgcttcggcacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgatcgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgtccgtcatgaagcgctactccgccccctccgagtccgagggcgtcctctga

SEQ ID NO: 13142 - RNA, 9867 nt, synthetic construct
  misc_feature 1..9867: note = derived and/or modified CDS sequence (opt2) from DENV-4__KJ579240__SS-prME
  source 1..9867: mol_type = other RNA
tccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggccctcatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccaccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctccgccacccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccgtcacctgcatcgccgtcggcggcatcaccctcttcctcggcttcaccgtccaggccgacatgggctgcgtcgtctcctggtccggccgcgagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgcctccgacctcaagtactcctggaagacctggggcaaggccaagatcttcacccccgaggcccgcaactccaccttcctcatcgacggccccgacacctccgagtgccccaacgagcgccgcgcctggaactccttcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagcgcgcctccctcatcgaggtcaagacctgcctctggcccaagacccacaccctctggtccaacggcgtcctcgagtcccagatgctcatccccaagtcctacgccggccccttctcccagcacaactaccgccagggctacgccacccagaccgtcggcccctggcacctcggcaagctcgagatcgacttcggcgagtgccccggcaccaccgtcaccatccaggagaactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcaccgccggccagggcacctccgagaccttctccatgggcctcctctgcctcaccctcttcgtcgaggagtgcctccgccgccgcgtcacccgcaagcacatgatcctcgccgtcgtcatcaccctctgcgccatcatcctcggcggcctcacctggatggacctcctccgcgccctcatcatgctcggcgacaccatgtccggccgcatcggcggccagacccacctcgccatcatcgccgtcttcaagatgtcccccggctacgtcctcggcgtcttcctccgcaagctcacctcccgcgagaccgccctcatggtcatcggcatggccatgaccaccaccctctccatcccccacgacctcatggagctcatcgacggcatctccctcggcctcatcctcctcaagatcgtcacccagttcgacaacacccaggtcggcaccctcgccctctccctcaccttcatccgctccaccatgtccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccatcaccatgaccctctggtacatgtggcaggtcaagacccagcgctccggcgccctctgggacgtcccctcccccgccgccacccagaaggccgccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgccccaagtggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcaccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccgccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagcacgccgtctcccgcggctcctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgcaagcacggcggcaacctcgtccgctgccccctctcccgcaactccacccacgagatgtactgggtctccggcgcctccggcaacatcgtctcctccgtcaacaccacctccaagatgctcctcaaccgcttcaccacccgccaccgcaagcccacctacgagaaggacgtcgacctcggcgccggcacccgctccgtctccaccgagatcgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatggtcatgaccaccaccgccaactggctctgggccctcctcggcaagaagaagaacccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggagatcgacaagaaggacggcgacctcatgtacgccgacgacaccgccggctgggacacccgcatcaccgaggacgacctccagaacgaggagctcatcaccgagcagatggccccccaccacaagatcctcgccaaggccatcttcaagctcacctaccagaacaaggtcgtcaaggtcctccgccccaccccccgcggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctccgcgagtgcggcgtcgaccgcctcaagcgcatggccatctccggcgacgactgcgtcgtcaagcccctcgacgagcgcttcggcacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgatcgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgtccgtcatgaagcgctactccgccccctccgagtccgagggcgtcctctga

SEQ ID NO: 13143 - RNA, 9867 nt, synthetic construct
  misc_feature 1..9867: note = derived and/or modified CDS sequence (opt2) from DENV-4__KJ596658__SS-prME
  source 1..9867: mol_type = other RNA
tccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggccctcatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccaccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctccgccacccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggtccggccgcgagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgcctccgacctcaagtactcctggaagacctggggcaaggccaagatcttcacccccgaggcccgcaactccaccttcctcatcgacggccccgacacctccgagtgccccaacgagcgccgcgcctggaactccttcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagcgcgcctccctcatcgaggtcaagacctgcctctggcccaagacccacaccctctggtccaacggcgtcctcgagtcccagatgctcatccccaagtcctacgccggccccttctcccagcacaactaccgccagggctacgccacccagaccgtcggcccctggcacctcggcaagctcgagatcgacttcggcgagtgccccggcaccaccgtcaccatccaggagaactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcaccgccggccagggcacctccgagaccttctccatgggcctcctctgcctcaccctcttcgtcgaggagtgcctccgccgccgcgtcacccgcaagcacatgatcctcgccgtcgtcatcaccctctgcgccatcatcctcggcggcctcacctggatggacctcctccgcgccctcatcatcctcggcgacaccatgtccggccgcatcggcggccagacccacctcgccatcatggccgtcttcaagatgtcccccggctacgtcctcggcgtcttcctccgcaagctcacctcccgcgagaccgccctcatggtcatcggcatggccatgaccaccaccctctccatcccccacgacctcatggagctcatcgacggcatctccctcggcctcatcctcctcaagatcgtcacccagttcgacaacacccaggtcggcaccctcgccctctccctcaccttcatccgctccaccatgtccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccatcaccatgaccctctggtacatgtggcaggtcaagacccagcgctccggcgccctctgggacgtcccctcccccgccgccacccagaaggccgccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgccccaagtggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcaccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccgccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagcacgccgtctcccgcggctcctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgcaagcacggcggcaacctcgtccgctgccccctctcccgcaactccacccacgagatgtactgggtctccggcgcctccggcaacatcgtctcctccgtcaacaccacctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatggtcatgaccaccaccgccaactggctctgggccctcctcggcaagaagaagaacccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggagatcgacaagaaggacggcgacctcatgtacgccgacgacaccgccggctgggacacccgcatcaccgaggacgacctccagaacgaggagctcatcaccgagcagatggccccccaccacaagatcctcgccaaggccatcttcaagctcacctaccagaacaaggtcgtcaaggtcctccgccccaccccccgcggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctccgcgagtgcggcgtcgaccgcctcaagcgcatggccatctccggcgacgactgcgtcgtcaagcccctcgacgagcgcttcggcacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgatcgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgtcatgaagcgctactccgccccctccgagtccgagggcgtcctctga

SEQ ID NO: 13144 - RNA, 9867 nt, synthetic construct
  misc_feature 1..9867: note = derived and/or modified CDS sequence (opt2) from DENV-4__KJ596659__SS-prME
  source 1..9867: mol_type = other RNA
tccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggccctcatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccaccggcgccgacacctccgaggtccactggaaccacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctccgccacccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggtccggccgcgagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgcctccgacctcaagtactcctggaagacctggggcaaggccaagatcttcacccccgaggcccgcaactccaccttcctcatcgacggccccgacacctccgagtgccccaacgagcgccgcgcctggaactccttcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagcgcgcctccctcatcgaggtcaagacctgcctctggcccaagacccacaccctctggtccaacggcgtcctcgagtcccagatgctcatccccaagtcctacgccggccccttctcccagcacaactaccgccagggctacgccacccagaccgtcggcccctggcacctcggcaagctcgagatcgacttcggcgagtgccccggcaccaccgtcaccatccaggagaactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcaccgccggccagggcacctccgagaccttctccatgggcctcctctgcctcaccctcttcgtcgaggagtgcctccgccgccgcgtcacccgcaagcacatgatcctcgccgtcgtcatcaccctctgcgccatcatcctcggcggcctcacctggatggacctcctccgcgccctcatcatcctcggcgacaccatgtccggccgcatcggcggccagacccacctcgccatcatggccgtcttcaagatgtcccccggctacgtcctcggcgtcttcctccgcaagctcacctcccgcgagaccgccctcatggtcatcggcatggccatgaccaccaccctctccatcccccacgacctcatggagctcatcgacggcatctccctcggcctcatcctcctcaagatcgtcacccagttcgacaacacccaggtcggcaccctcgccctctccctcaccttcatccgctccaccatgtccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccatcaccatgaccctctggtacatgtggcaggtcaagacccagcgctccggcgccctctgggacgtcccctcccccgccgccacccagaaggccgccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgccccaagtggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcaccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccgccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagcacgccgtctcccgcggctcctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgcaagcacggcggcaacctcgtccgctgccccctctcccgcaactccacccacgagatgtactgggtctccggcgcctccggcaacatcgtctcctccgtcaacaccacctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatggtcatgaccaccaccgccaactggctctgggccctcctcggcaagaagaagaacccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggagatcgacaagaaggacggcgacctcatgtacgccgacgacaccgccggctgggacacccgcatcaccgaggacgacctccagaacgaggagctcatcaccgagcagatggccccccaccacaagatcctcgccaaggccatcttcaagctcacctaccagaacaaggtcgtcaaggtcctccgccccaccccccgcggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctccgcgagtgcggcgtcgaccgcctcaagcgcatggccatctccggcgacgactgcgtcgtcaagcccctcgacgagcgcttcggcacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgatcgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgtcatgaagcgctactccgccccctccgagtccgagggcgtcctctga

SEQ ID NO: 13145 - RNA, 9867 nt, synthetic construct
  misc_feature 1..9867: note = derived and/or modified CDS sequence (opt2) from DENV-4__KJ596661__SS-prME
  source 1..9867: mol_type = other RNA
tccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggccctcatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccaccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctccgccacccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggtccggccgcgagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgcctccgacctcaagtactcctggaagacctggggcaaggccaagatcttcacccccgaggcccgcaactccaccttcctcatcgacggccccgacacctccgagtgccccaacgagcgccgcgcctggaactccttcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagcgcgcctccctcatcgaggtcaagacctgcctctggcccaagacccacaccctctggtccaacggcgtcctcgagtcccagatgctcatccccaagtcctacgccggccccttctcccagcacaactaccgccagggctacgccacccagaccgtcggcccctggcacctcggcaagctcgagatcgacttcggcgagtgccccggcaccaccgtcaccatccaggagaactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcaccgccggccagggcacctccgagaccttctccatgggcctcctctgcctcaccctcttcgtcgaggagtgcctccgccgccgcgtcacccgcaagcacatgatcctcgccgtcgtcatcaccctctgcgccatcatcctcggcggcctcacctggatggacctcctccgcgccctcatcatgctcggcgacaccatgtccggccgcatcggcggccagacccacctcgccatcatggccgtcttcaagatgtcccccggctacgtcctcggcgtcttcctccgcaagctcacctcccgcgagaccgccctcatggtcatcggcatggccatgaccaccaccctctccatcccccacgacctcatggagctcatcgacggcatctccctcggcctcatcctcctcaagatcgtcacccagttcgacaacacccaggtcggcaccctcgccctctccctcaccttcatccgctccaccatgtccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccatcaccatgaccctctggtacatgtggcaggtcaagacccagcgctccggcgccctctgggacgtcccctcccccgccgccacccagaaggccgccctctccgagggcgtctaccgcatcatgcagcgcggcctcttcggcaagacccaggtcggcgtcggcatccacatcgagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgccccaagtggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcaccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccttctgcgaggtcctcaccctcgccaccggccccaccctcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccgccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagcacgccgtctcccgcggctcctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgcaagcacggcggcaacctcgtccgctgccccctctcccgcaactccacccacgagatgtactgggtctccggcgcctccggcaacatcgtctcctccgtcaacaccacctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatggtcatgaccaccaccgccaactggctctgggccctcctcggcaagaagaagaacccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggagatcgacaagaaggacggcgacctcatgtacgccgacgacaccgccggctgggacacccgcatcaccgaggacgacctccagaacgaggagctcatcaccgagcagatggccccccaccacaagatcctcgccaaggccatcttcaagctcacctaccagaacaaggtcgtcaaggtcctccgccccaccccccgcggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctccgcgagtgcggcgtcgaccgcctcaagcgcatggccatctccggcgacgactgcgtcgtcaagcccctcgacgagcgcttcggcacctccctcctcttcctcaacgacatgggcaaggcccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgatcgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgtcatgaagcgctactccgccccctccgagtccgagggcgtcctctga

SEQ ID NO: 13146 - RNA, 9867 nt, synthetic construct
  misc_feature 1..9867: note = derived and/or modified CDS sequence (opt2) from DENV-4__KJ596663__SS-prME
  source 1..9867: mol_type = other RNA
tccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggccctcatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccaccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctccgccacccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggtccggccgcgagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgcctccgacctcaagtactcctggaagacctggggcaaggccaagatcttcacccccgaggcccgcaactccaccttcctcatcgacggccccgacacctccgagtgccccaacgagcgccgcgcctggaactccttcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagcgcgcctccctcatcgaggtcaagacctgcctctggcccaagacccacaccctctggtccaacggcgtcctcgagtcccagatgctcatccccaagtcctacgccggccccttctcccagcacaactaccgccagggctacgccacccagaccgtcggcccctggcacctcggcaagctcgagatcgacttcggcgagtgccccggcaccaccgtcaccatccaggagaactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcaccgccggccagggcacctccgagaccttctccatgggcctcctctgcctcaccctcttcgtcgaggagtgcctccgccgccgcgtcacccgcaagcacatgatcctcgccgtcgtcatcaccctctgcgccatcatcctcggcggcctcacctggatggacctcctccgcgccctcatcatcctcggcgacaccatgtccggccgcatcggcggccagacccacctcgccatcatggccgtcttcaagatgtcccccggctacgtcctcggcgtcttcctccgcaagctcacctcccgcgagaccgccctcatggtcatcggcatggccatgaccaccaccctctccatcccccacgacctcatggagctcatcgacggcatctccctcggcctcatcctcctcaagatcgtcacccagttcgacaacacccaggtcggcaccctcgccctctccctcaccttcatccgctccaccatgtccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccatcaccatgaccctctggtacatgtggcaggtcaagacccagcgctccggcgccctctgggacgtcccctcccccgccgccacccagaaggccgccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgccccaagtggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcaccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccgccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagcacgccgtctcccgcggctcctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgcaagcacggcggcaacctcgtccgctgccccctctcccgcaactccacccacgagatgtactgggtctccggcgcctccggcaacatcgtctcctccgtcaacaccacctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatggtcatgaccaccaccgccaactggctctgggccctcctcggcaagaagaagaacccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggagatcgacaagaaggacggcgacctcatgtacgccgacgacaccgccggctgggacacccgcatcaccgaggacgacctccagaacgaggagctcatcaccgagcagatggccccccaccacaagaccctcgccaaggccatcttcaagctcacctaccagaacaaggtcgtcaaggtcctccgccccaccccccgcggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctccgcgagtgcggcgtcgaccgcctcaagcgcatggccatctccggcgacgactgcgtcgtcaagcccctcgacgagcgcttcggcacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgatcgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgtcatgaagcgctactccgccccctccgagtccgagggcgtcctctga

SEQ ID NO: 13147 - RNA, 9867 nt, synthetic construct
  misc_feature 1..9867: note = derived and/or modified CDS sequence (opt2) from DENV-4__KJ596664__SS-prME
  source 1..9867: mol_type = other RNA
tccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggccctcatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccaccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctccgccacccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggtccggccgcgagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgcctccgacctcaagtactcctggaagacctggggcaaggccaagatcttcacccccgaggcccgcaactccaccttcctcatcgacggccccgacacctccgagtgccccaacgagcgccgcgcctggaactccttcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagcgcgcctccctcatcgaggtcaagacctgcctctggcccaagacccacaccctctggtccaacggcgtcctcgagtcccagatgctcatccccaagtcctacgccggccccttctcccagcacaactaccgccagggctacgccacccagaccgtcggcccctggcacctcggcaagctcgagatcgacttcggcgagtgccccggcaccaccgtcaccatccaggagaactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcaccgccggccagggcacctccgagaccttctccatgggcctcctctgcctcaccctcttcgtcgaggagtgcctccgccgccgcgtcacccgcaagcacatgatcctcgccgtcgtcatcaccctctgcgccatcatcctcggcggcctcacctggatggacctcctccgcgccctcatcatgctcggcgacaccatgtccggccgcatcggcggccagacccacctcgccatcatcgccgtcttcaagatgtcccccggctacgtcctcggcgtcttcctccgcaagctcacctcccgcgagaccgccctcatggtcatcggcatggccatgaccaccaccctctccatcccccacgacctcatggagctcatcgacggcatctccctcggcctcatcctcctcaagatcgtcacccagttcgacaacacccaggtcggcaccctcgccctctccctcaccttcatccgctccaccatgtccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccatcaccatgaccctctggtacatgtggcaggtcaagacccagcgctccggcgccctctgggacgtcccctcccccgccgccacccagaaggccgccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgccccaagtggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcaccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccgccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagcacgccgtctcccgcggctcctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgcaagcacggcggcaacctcgtccgctgccccctctcccgcaactccacccacgagatgtactgggtctccggcgcctccggcaacatcgtctcctccgtcaacaccacctccaagatgctcctcaaccgcttcaccacccgccaccgcaagcccacctacgagaaggacgtcgacctcggcgccggcacccgctccgtctccaccgagatcgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatggtcatgaccaccaccgccaactggctctgggccctcctcggcaagaagaagaacccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggagatcgacaagaaggacggcgacctcatgtacgccgacgacaccgccggctgggacacccgcatcaccgaggacgacctccagaacgaggagctcatcaccgagcagatggccccccaccacaagatcctcgccaaggccatcttcaagctcacctaccagaacaaggtcgtcaaggtcctccgccccaccccccgcggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctccgcgagtgcggcgtcgaccgcctcaagcgcatggccatctccggcgacgactgcgtcgtcaagcccctcgacgagcgcttcggcacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggaacctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgatcgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgtccgtcatgaagcgctactccgccccctccgagtccgagggcgtcctctga

SEQ ID NO: 13148 - RNA, 9867 nt, synthetic construct
  misc_feature 1..9867: note = derived and/or modified CDS sequence (opt2) from DENV-4__KJ596665__SS-prME
  source 1..9867: mol_type = other RNA
tccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggccctcatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccaccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctccgccacccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggtccggccgcgagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgcctccggcctcaagtactcctggaagacctggggcaaggccaagatcttcacccccgaggcccgcaactccaccttcctcatcgacggccccgacacctccgagtgccccaacgagcgccgcgcctggaactccttcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagcgcgcctccctcatcgaggtcaagacctgcctctggcccaagacccacaccctctggtccaacggcgtcctcgagtcccagatgctcatccccaagtcctacgccggccccttctcccagcacaactaccgccagggctacgccacccagaccgtcggcccctggcacctcggcaagctcgagatcgacttcggcgagtgccccggcaccaccgtcaccatccaggagaactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcaccgccggccagggcacctccgagaccttctccatgggcctcctctgcctcaccctcttcgtcgaggagtgcctccgccgccgcgtcacccgcaagcacatgatcctcgccgtcgtcatcaccctctgcgccatcatcctcggcggcctcacctggatggacctcctccgcgccctcatcatcctcggcgacaccatgtccggccgcatcggcggccagacccacctcgccatcatggccgtcttcaagatgtcccccggctacgtcctcggcgtcttcctccgcaagctcacctcccgcgagaccgccctcatggtcatcggcatggccatgaccaccaccctctccatcccccacgacctcatggagctcatcgacggcatctccctcggcctcatcctcctcaagatcgtcacccagttcgacaacacccaggtcggcaccctcgccctctccctcaccttcatccgctccaccatgtccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccatcaccatgaccctctggtacatgtggcaggtcaagacccagcgctccggcgccctctgggacgtcccctcccccgccgccacccagaaggccgccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgccccaagtggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcaccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccgccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagcacgccgtctcccgcggctcctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgcaagcacggcggcaacctcgtccgctgccccctctcccgcaactccacccacgagatgtactgggtctccggcgcctccggcaacatcgtctcctccgtcaacaccacctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatggtcatgaccaccaccgccaactggctctgggccctcctcggcaagaagaagaacccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggagatcgacaagaaggacggcgacctcatgtacgccgacgacaccgccggctgggacacccgcatcaccgaggacgacctccagaacgaggagctcatcaccgagcagatggccccccaccacaagatcctcgccaaggccatcttcaagctcacctaccagaacaaggtcgtcaaggtcctccgccccaccccccgcggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctccgcgagtgcggcgtcgaccgcctcaagcgcatggccatctccggcgacgactgcgtcgtcaagcccctcgacgagcgcttcggcacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgagaacatgctcaaggtctggaaccgcgtctggatcgaggacaaccccaacatgatcgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgtcatgaagcgctactccgccccctccgagtccgagggcgtcctctga

SEQ ID NO: 13149 - RNA, 9867 nt, synthetic construct
  misc_feature 1..9867: note = derived and/or modified CDS sequence (opt2) from DENV-4__KJ596668__SS-prME
  source 1..9867: mol_type = other RNA
tccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggccctcatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccaccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctccgccacccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggtccggccgcgagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgcctccgacctcaagtactcctggaagacctggggcaaggccaagatcttcacccccgaggcccgcaactccaccttcctcatcgacggccccgacacctccgagtgccccaacgagcgccgcgcctggaactccttcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagcgcgcctccctcatcgaggtcaagacctgcctctggcccaagacccacaccctctggtccaacggcgtcctcgagtcccagatgctcatccccaagtcctacgccggccccttctcccagcacaactaccgccagggctacgccacccagaccgtcggcccctggcacctcggcaagctcgagatcgacttcggcgagtgccccggcaccaccgtcaccatccaggagaactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcaccgccggccagggcacctccgagaccttctccatgggcctcctctgcctcaccctcttcgtcgaggagtgcctccgccgccgcgtcacccgcaagcacatgatcctcgccgtcgtcatcaccctctgcgccatcatcctcggcggcctcacctggatggacctcctccgcgccctcatcatcctcggcgacaccatgtccggccgcatcggcggccagacccacctcgccatcatggccgtcttcaagatgtcccccggctacgtcctcggcgtcttcctccgcaagctcacctcccgcgagaccgccctcatggtcatcggcatggccatgaccaccaccctctccatcccccacgacctcatggagctcatcgacggcatctccctcggcctcatcctcctcaagatcgtcacccagttcgacaacacccaggtcggcaccctcgccctctccctcaccttcatccgctccaccatgtccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccgtcaccatgaccctctggtacatgtggcaggtcaagacccagcgctccggcgccctctgggacgtcccctcccccgccgccacccagaaggccgccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgccccaagtggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcaccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccgccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagcacgccgtctcccgcggctcctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgcaagcacggcggcaacctcgtccgctgccccctctcccgcaactccacccacgagatgtactgggtctccggcgcctccggcaacatcgtctcctccgtcaacaccacctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatggtcatgaccaccaccgccaactggctctgggccctcctcggcaagaagaagaacccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggagatcgacaagaaggacggcgacctcatgtacgccgacgacaccgccggctgggacacccgcatcaccgaggacgacctccagaacgaggagctcatcaccgagcagatggccccccaccacaagatcctcgccaaggccatcttcaagctcacctaccagaacaaggtcgtcaaggtcctccgccccaccccccgcggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctccgcgagtacggcgtcgaccgcctcaagcgcatggccatctccggcgacgactgcgtcgtcaagcccctcgacgagcgcttcggcacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgatcgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgtcatgaagcgctactccgccccctccgagtccgagggcgtcctctga

SEQ ID NO: 13150 - RNA, 9867 nt, synthetic construct
  misc_feature 1..9867: note = derived and/or modified CDS sequence (opt2) from DENV-4__KJ596670__SS-prME
  source 1..9867: mol_type = other RNA
tccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggccctcatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccaccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctccgccacccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggtccggccgcgagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgcctccgacctcaagtactcctggaagacctggggcaaggccaagatcttcacccccgaggcccgcaactccaccttcctcatcgacggccccgacacctccgagtgccccaacgagcgccgcgcctggaactccttcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagcgcgcctccctcatcgaggtcaagacctgcctctggcccaagacccacaccctctggtccaacggcgtcctcgagtcccagatgctcatccccaagtcctacgccggccccttctcccagcacaactaccgccagggctacgccacccagaccgtcggcccctggcacctcggcaagctcgagatcgacttcggcgagtgccccggcaccaccgtcaccatccaggagaactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcaccgccggccagggcacctccgagaccttctccatgggcctcctctgcctcaccctcttcgtcgaggagtgcctccgccgccgcgtcacccgcaagcacatgatcctcgccgtcgtcatcaccctctgcgccatcgtcctcggcggcctcacctggatggacctcctccgcgccctcatcatgctcggcgacaccatgtccggccgcatcggcggccagacccacctcgccatcatcgccgtcttcaagatgtcccccggctacgtcctcggcgtcttcctccgcaagctcacctcccgcgagaccgccctcatggtcatcggcatggccatgaccaccaccctctccatcccccacgacctcatggagctcatcgacggcatctccctcggcctcatcctcctcaagatcgtcacccagttcgacaacacccaggtcggcaccctcgccctctccctcaccttcatccgctccaccatgtccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccatcaccatgaccctctggtacatgtggcaggtcaagacccagcgctccggcgccctctgggacgtcccctcccccgccgccacccagaaggccgccctctccgagggcgtctaccgcatcatgcagcgcggcctcttcggcaagacccagatcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgccccaagtggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcaccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccgccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagcacgccgtctcccgcggctcctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgcaagcacggcggcaacctcgtccgctgccccctctcccgcaactccacccacgagatgtactgggtctccggcgcctccggcaacatcgtctcctccgtcaacaccacctccaagatgctcctcaaccgcttcaccacccgccaccgcaagcccacctacgagaaggacgtcgacctcggcgccggcacccgctccgtctccaccgagatcgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatggtcatgaccaccaccgccaactggctctgggccctcctcggcaagaagaagaacccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggagatcgacaagaaggacggcgacctcatgtacgccgacgacaccgccggctgggacacccgcatcaccgaggacgacctccagaacgaggagctcatcaccgagcagatggccccccaccacaagatcctcgccaaggccatcttcaagctcacctaccagaacaaggtcgtcaaggtcctccgccccaccccccgcggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctccgcgagtgcggcgtcgaccgcctcaagcgcatggccatctccggcgacgactgcgtcgtcaagcccctcgacgagcgcttcggcacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgatcgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgtccgtcatgaagcgctactccgccccctccgagtccgagggcgtcctctga

SEQ ID NO: 13151 - RNA, 9867 nt, synthetic construct
  misc_feature 1..9867: note = derived and/or modified CDS sequence (opt2) from DENV-4__KJ596671__SS-prME
  source 1..9867: mol_type = other RNA
tccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggccctcatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccaccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctccgccacccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggtccggccgcgagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgcctccgacctcaagtactcctggaagacctggggcaaggccaagatcttcacccccgaggcccgcaactccaccttcctcatcgacggccccgacacctccgagtgccccaacgagcgccgcgcctggaactccttcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagcgcgcctccctcatcgaggtcaagacctgcctctggcccaagacccacaccctctggtccaacggcgtcctcgagtcccagatgctcatccccaagtcctacgccggccccttctcccagcacaactaccgccagggctacgccacccagaccgtcggcccctggcacctcggcaagctcgagatcgacttcggcgagtgccccggcaccaccgtcaccatccaggagaactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcaccgccggccagggcacctccgagaccttctccatgggcctcctctgcctcaccctcttcgtcgaggagtgcctccgccgccgcgtcacccgcaagcacatgatcctcgccgtcgtcatcaccctctgcgccatcatcctcggcggcctcacctggatggacctcctccgcgccctcatcatgctcggcgacaccatgtccggccgcatcggcggccagacccacctcgccatcatcgccgtcttcaagatgtcccccggctacgtcctcggcgtcttcctccgcaagctcacctcccgcgagaccgccctcatggtcatcggcatggccatgaccaccaccctctccatcccccacgacctcatggagctcatcgacggcatctccctcggcctcatcctcctcaagatcgtcacccagttcgacaacacccaggtcggcaccctcgccctctccctcaccttcatccgctccaccatgtccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccatcaccatgaccctctggtacatgtggcaggtcaagacccagcgctccggcgccctctgggacgtcccctcccccgccgccacccagaaggccgccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgccccaagtggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcaccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccgccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagcacgccgtctcccgcggctcctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgcaagcacggcggcaacctcgtccgctgccccctctcccgcaactccacccacgagatgtactgggtctccggcgcctccggcaacatcgtctcctccgtcaacaccacctccaagatgctcctcaaccgcttcaccacccgccaccgcaagcccacctacgagaaggacgtcgacctcggcgccggcacccgctccgtctccaccgagatcgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatggtcatgaccaccaccgccaactggctctgggccctcctcggcaagaagaagaacccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggagatcgacaagaaggacggcgacctcatgtacgccgacgacaccgccggctgggacacccgcatcaccgaggacgacctccagaacgaggagctcatcaccgagcagatggccccccaccacaagatcctcgccaaggccatcttcaagctcacctaccagaacaaggtcgtcaaggtcctccgccccaccccccgcggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctccgcgagtgcggcgtcgaccgcctcaagcgcatggccatctccggcgacgactgcgtcgtcaagcccctcgacgagcgcttcggcacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgatcgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgtccgtcatgaagcgctactccgccccctccgagtccgagggcgtcctctga

SEQ ID NO: 13152 - RNA, 9867 nt, synthetic construct
  misc_feature 1..9867: note = derived and/or modified CDS sequence (opt2) from DENV-4__KJ579241__SS-prME
  source 1..9867: mol_type = other RNA
tccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggccctcatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccaccggcgccgacacctccgaggtccactggaactacaaggagcgcatggtcaccttcaagatcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctccgccacccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggtccggccgcgagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgcctccgacctcaagtactcctggaagacctggggcaaggccaagatcttcacccccgaggcccgcaactccaccttcctcatcgacggccccgacacctccgagtgccccaacgagcgccgcgcctggaactccttcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagcgcgcctccctcatcgaggtcaagacctgcctctggcccaagacccacaccctctggtccaacggcgtcctcgagtcccagatgctcatccccaagtcctacgccggccccttctcccagcacaactaccgccagggctacgccacccagaccgtcggcccctggcacctcggcaagctcgagatcgacttcggcgagtgccccggcaccaccgtcaccatccaggagaactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcaccgccggccagggcacctccgagaccttctccatgggcctcctctgcctcaccctcttcgtcgaggagtgcctccgccgccgcgtcacccgcaagcacatgatcctcgccgtcgtcatcaccctctgcgccatcatcctcggcggcctcacctggatggacctcctccgcgccctcatcatcctcggcgacaccatgtccggccgcatcggcggccagacccacctcgccatcatggccgtcttcaagatgtcccccggctacgtcctcggcgtcttcctccgcaagctcacctcccgcgagaccgccctcatggtcatcggcatggccatgaccaccaccctctccatcccccacgacctcatggagctcatcgacggcatctccctcggcctcatcctcctcaagatcgtcacccagttcgacaacacccaggtcggcaccctcgccctctccctcaccttcatccgctccaccatgtccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccatcaccatgaccctctggtacatgtggcaggtcaagacccagcgctccggcgccctctgggacgtcccctcccccgccgccacccagaaggccgccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgccccaagtggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcaccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccgccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagcacgccgtctcccgcggctcctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccatgcgcgtcctcaagatggtcgagccctggctctcctccaagcccgagttctgcatcaaggtcctcaacccctacatgcccaccgtcatcgaggagctcgagaagctccagcgcaagcacggcggcaacctcgtccgctgccccctctcccgcaactccacccacgagatgtactgggtctccggcgcctccggcaacatcgtctcctccgtcaacaccacctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatggtcatgaccaccaccgccaactggctctgggccctcctcggcaagaagaagaacccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggagatcgacaagaaggacggcgacctcatgtacgccgacgacaccgccggctgggacacccgcatcaccgaggacgacctccagaacgaggagctcatcaccgagcagatggccccccaccacaagatcctcgccaaggccatcttcaagctcacctaccagaacaaggtcgtcaaggtcctccgccccaccccccgcggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctccgcgagtgcggcgtcgaccgcctcaagcgcatggccatctccggcgacgactgcgtcgtcaagcccctcgacgagcgcttcggcacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgatcgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgtcatgaagcgctactccgccccctccgagtccgagggcgtcctctga

SEQ ID NO: 13153 - RNA, 9867 nt, synthetic construct
  misc_feature 1..9867: note = derived and/or modified CDS sequence (opt2) from DENV-4__KJ596672__SS-prME
  source 1..9867: mol_type = other RNA
tccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggccctcatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccaccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctccgccacccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggtccggccgcgagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgcctccgacctcaagtactcctggaagacctggggcaaggccaagatcttcacccccgaggcccgcaactccaccttcctcatcgacggccccgacacctccgagtgccccaacgagcgccgcgcctggaactccttcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagcgcgcctccctcatcgaggtcaagacctgcctctggcccaagacccacaccctctggtccaacggcgtcctcgagtcccagatgctcatccccaagtcctacgccggccccttctcccagcacaactaccgccagggctacgccacccagaccgtcggcccctggcacctcggcaagctcgagatcgacttcggcgagtgccccggcaccaccgtcaccatccaggagaactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcaccgccggccagggcacctccgagaccttctccatgggcctcctctgcctcaccctcttcgtcgaggagtgcctccgccgccgcgtcacccgcaagcacatgatcctcgccgtcgtcatcaccctctgcgccatcatcctcggcggcctcacctggatggacctcctccgcgccctcatcatgctcggcgacaccatgtccggccgcatcggcggccagacccacctcgccatcatcgccgtcttcaagatgtcccccggctacgtcctcggcgtcttcctccgcaagctcacctcccgcgagaccgccctcatggtcatcggcatggccatgaccaccaccctctccatcccccacgacctcatggagctcatcgacggcatctccctcggcctcatcctcctcaagatcgtcacccagttcgacaacacccaggtcggcaccctcgccctctccctcaccttcatccgctccaccatgtccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccatcaccatgaccctctggtacatgtggcaggtcaagacccagcgctccggcgccctctgggacgtcccctcccccgccgccacccagaaggccgccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccatcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgccccaagtggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcaccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccgccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagcacgccgtctcccgcggctcctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgcaagcacggcggcaacctcgtccgctgccccctctcccgcaactccacccacgagatgtactgggtctccggcgcctccggcaacatcgtctcctccgtcaacaccacctccaagatgctcctcaaccgcttcaccacccgccaccgcaagcccacctacgagaaggacgtcgacctcggcgccggcacccgctccgtctccaccgagatcgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatggtcatgaccaccaccgccaactggctctgggccctcctcggcaagaagaagaacccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggagatcgacaagaaggacggcgacctcatgtacgccgacgacaccgccggctgggacacccgcatcaccgaggacgacctccagaacgaggagctcatcaccgagcagatggccccccaccacaagatcctcgccaaggccatcttcaagctcacctaccagaacaaggtcgtcaaggtcctccgccccaccccccgcggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctccgcgagtgcggcgtcgaccgcctcaagcgcatggccatctccggcgacgactgcgtcgtcaagcccctcgacgagcgcttcggcacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgatcgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgtccgtcatgaagcgctactccgccccctccgagtccgagggcgtcctctga

SEQ ID NO: 13154 - RNA, 9867 nt, synthetic construct
  misc_feature 1..9867: note = derived and/or modified CDS sequence (opt2) from DENV-4__KJ579242__SS-prME
  source 1..9867: mol_type = other RNA
tccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggccctcatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccaccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctccgccacccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggtccggccgcgagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgcctccgacctcaagtactcctggaagacctggggcaaggccaagatcttcacccccgaggcccgcaactccaccttcctcatcgacggccccgacacctccgagtgccccaacgagcgccgcgcctggaactccttcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagcgcgcctccctcatcgaggtcaagacctgcctctggcccaagacccacaccctctggtccaacggcgtcctcgagtcccagatgctcatccccaagtcctacgccggccccttctcccagcacaactaccgccagggctacgccacccagaccgtcggcccctggcacctcggcaagctcgagatcgacttcggcgagtgccccggcaccaccgtcaccatccaggagaactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcaccgccggccagggcacctccgagaccttctccatgggcctcctctgcctcaccctcttcgtcgaggagtgcctccgccgccgcgtcacccgcaagcacatgatcctcgccgtcgtcatcaccctctgcgccatcatcctcggcggcctcacctggatggacctcctccgcgccctcatcatcctcggcgacaccatgtccggccgcatcggcggccagacccacctcgccatcatggccgtcttcaagatgtcccccggctacgtcctcggcgtcttcctccgcaagctcacctcccgcgagaccgccctcatggtcatcggcatggccatgaccaccaccctctccatcccccacgacctcatggagctcatcgacggcatctccctcggcctcatcctcctcaagatcgtcacccagttcgacaacacccaggtcggcaccctcgccctctccctcaccttcatccgctccaccatgtccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccatcaccatgaccctctggtacatgtggcaggtcaagacccagcgctccggcgccctctgggacgtcccctcccccgccgccacccagaaggccgccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgccccaagtggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcaccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgtcttctccctcatcaagaacgcccagaccccccgccgcggcaccggcaccgccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagcacgccgtctcccgcggctcctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccatgcgcgtcctcaagatggtcgagccctggctctcctccaagcccgagttctgcatcaaggtcctcaacccctacatgcccaccgtcatcgaggagctcgagaagctccagcgcaagcacggcggcaacctcgtccgctgccccctctcccgcaactccacccacgagatgtactgggtctccggcgcctccggcaacatcgtctcctccgtcaacaccacctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatggtcatgaccaccaccgccaactggctctgggccctcctcggcaagaagaagaacccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggagatcgacaagaaggacggcgacctcatgtacgccgacgacaccgccggctgggacacccgcatcaccgaggacgacctccagaacgaggagctcatcaccgagcagatggccccccaccacaagatcctcgccaaggccatcttcaagctcacctaccagaacaaggtcgtcaaggtcctccgccccaccccccgcggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctccgcgagtgcggcgtcgaccgcctcaagcgcatggccatctccggcgacgactgcgtcgtcaagcccctcgacgagcgcttcggcacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgatcgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgtcatgaagcgctactccgccccctccgagtccgagggcgtcctctga

SEQ ID NO: 13155 - RNA, 9867 nt, synthetic construct
  misc_feature 1..9867: note = derived and/or modified CDS sequence (opt2) from DENV-4__GQ398256__SS-prME
  source 1..9867: mol_type = other RNA
tccaccatgaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagaacggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggcctccatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttcctctgctccggcaagatcaccggcaacctcgtccagatcgagaacctcgagtacaccgtcgccgtcaccgtccacaacggcgacacccacgccgtcggcaacgacacctcctcccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccgccggcgccgacacctccgaggtccactggaaccacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcatcatctcctccacccccttcgccgagaacaccaactccgtcaccaacatcgagctcgagccccccttcggcgactcctacatcgtcatcggcgtcggcgagtccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatggtccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggaacggcaaggagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgtcaacgacctcaagtactcctggaagacctggggcaaggccaagatcttcacccccgaggcccgcaactccaccttcctcatcgacggccccgacacctccgagtgccccaacgagcgccgcgcctggaacttcttcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagaaggcctccctcatcgaggtcaagacctgcctctggcccaagacccacaccctctggtccaacggcgtcctcgagtcccagatgctcatcccccgctcctacgccggccccttctcccagcacaactaccgccagggctacgccacccagaccgtcggcccctggcacctcggcaagctcgagatcgacttcggcgagtgccccggcaccaccgtcgccatccgcgaggactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcaccgccggccagggcacctccgagaccttctccatgggcctcctctgcctcaccctcttcgtcgaggagtgcctccgccgccgcgtcacccgcaagcacatgatcctcgtcgtcgtcatcaccttctgcgccatcatcctcggcggcctcacctggatggacctcctccgcgccctcatcatgctcggcgacaccatgtccggccgcatcggcggccagatccacctcgccatcatggccgtcttcaagatgtcccccggctacgtcctcggcgtcttcctccgcaagctcacctcccgcgagaccgccctcatggtcatcggcatggccatgaccaccgtcttctccatcccccacgacctcatggagctcatcgacggcatctccctcggcctcatcctcctcaagatcgtcacccacttcgacaacacccaggtcggcaccctcgccctctccctcaccttcctccgctccaccatccccctcgtcatggcctggcgcaccatcatggccgtcttcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccgtcaccatggccctctggtacatctggcaggtcaagacccagcgctccggcgccctctgggacgtcccctcccccgccgccacccagaaggccaccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaacaagaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctgctccgtcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagcgcgtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgaagcgcggcgacctccccgtctggctctcctacaaggtcgcctccgccggcatctcctacaaggaccgcgagtggtgcttcaccggcgagcgcaacaaccagatcctcgaggagaacatggaggtcgagatctggaccaaggagggcgagaagaagaagctccgccccaagtggctcgacgcccgcgtctacgccgaccccatggccctcaaggacttcaaggagttcgcctccggccgcaagtccatcaccctcgacatcctcaccgagatcgcctccctccccacctacctctcctccaaggccaagctcgccctcgacaacatcgtcatgctccacaccaccgagaagggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcgccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatcggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgtcggccagctcctcctcatgcgcaccacctgggccctctgcgaggtcctcaccctcgccaccggccccgccatgaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagcacgccgtctcccgcggctcctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgccgctacggcggctccctcgtccgctgccccctctcccgcaactccacccacgagatgtactgggtctccggcgcctccggcaacatcgtctcctccgtcaacaccatctccaagatgctcctcaaccgcttcaccacccgccaccgcaagcccacctacgagaaggacgtcgacctcggcgccggcacccgctccgtctccaccgagaccgagaagcccgacatgaccgtcatcggccgccgcctccagcgcctccaggaggagcacaaggagacctggcactacgaccaggagaacccctaccgcacctgggcctaccacggctcctacgaggccccctccaccggctccgcctcctccatggtcaacggcatcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatgatcatgaccaccaccgccaactggctctgggccctcctcggcaagaagaagtccccccgcctctgcacccgcgaggagttcatctccaaggtccgctccaacgccgccatcggcgccgtcttccaggaggagcagggctggacctccgcctccgaggccgtcaacgactcccgcttctgggagctcgtcaacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttctcccgcgagaactcctggtccggcgtcgagggcgagggcctccaccgcctcggctacatcctcgaggacatcgacaagcaggacggcgacctcatctacgccgacgacaccgccggctgggacacccgcatcaccgaggacgacctcctcaacgaggagctcatcaccgagcagatggccccccaccacaagaccctcgccaaggccatcttcaagctcacctaccagaacaaggtcgtcaaggtcctccgccccacccccaagggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctcaccgagtgcggcgtcgaccgcctcaagcgcatggccatctccggcgacgactgcgtcgtcaagcccctcgacgagcgcttctccgcctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgaccgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgtcatgaagcgctactccgccccctccgagtccgagggcgtcctctga

SEQ ID NO: 13156 - RNA, 9867 nt, synthetic construct
  misc_feature 1..9867: note = derived and/or modified CDS sequence (opt2) from DENV-4__KC333651__SS-prME
  source 1..9867: mol_type = other RNA
tccaccatgaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagaacggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcatcgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggcctccatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttcctctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccgccggcgccgacacctccgaggtccactggaaccacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcatcatctcctccacccccttcgccgagaacaccaactccgtcaccaacatcgagctcgagccccccttcggcgactcctacatcgtcatcggcgtcggcgagtccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatggtccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggaacggcaaggagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgtcaacgacctcaagtactcctggaagacctggggcaaggccaagatcttcacccccgaggcccgcaactccaccttcctcatcgacggccccgacacctccgagtgccccaacgagcgccgcgcctggaacttcttcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagaaggcctccctcatcgaggtcaagacctgcctctggcccaagacccacaccctctggtccaacggcgtcctcgagtcccagatgctcatcccccgctcctacgccggccccttctcccagcacaactaccgccagggctacgccacccagaccgtcggcccctggcacctcggcaagctcgagatcgacttcggcgagtgccccggcaccaccgtcgccatccgcgaggactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcaccgccggccagggcacctccgagaccttctccatgggcctcctctgcctcaccctcttcgtcgaggagtgcctccgccgccgcgtcacccgcaagcacatgatcctcgtcgtcgtcatcaccttctgcgccatcatcctcggcggcctcacctggatggacctcctccgcgccctcatcatgctcggcgacaccatgtccggccgcatcggcggccagatccacctcgccatcatggccgtcttcaagatgtcccccggctacgtcctcggcgtcttcctccgcaagctcacctcccgcgagaccgccctcatggtcatcggcatggccatgaccaccgtcttctccatcccccacgacctcatggagctcatcgacggcatctccctcggcctcatcctcctcaagatcgtcacccacttcgacaacacccaggtcggcaccctcgccctctccctcaccttcctccgctccaccatccccctcgtcatggcctggcgcaccatcatggccgtcttcttcgtcgtcaccctcatccccctctgccgcacctcctgcctccagaagcactcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctcctcctcgagaaggccgccaacgtccagtgggacgagatggccgacatcaccggctcctcccccatcatcgaggtcaagcaggacgaggacggctccttctccatccgcgacgtcgaggagaccaacatgatgaccctcctcgtcaagctcgccctcatcaccgtctccggcctctaccccctcgccatccccgtcaccatggccctctggtacatctggcaggtcaagacccagcgctccggcgccctctgggacgtcccctcccccgccgccacccagaaggccaccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaacaagaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctgctccgtcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagcgcgtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgaagcgcggcgacctccccgtctggctctcctacaaggtcgcctccgccggcatctcctacaaggaccgcgagtggtgcttcaccggcgagcgcaacaaccagatcctcgaggagaacatggaggtcgagatctggaccaaggagggcgagaagaagaagctccgccccaagtggctcgacgcccgcgtctacgccgaccccatggccctcaaggacttcaaggagttcgcctccggccgcaagtccatcaccctcgacatcctcaccgagatcgcctccctccccacctacctctcctccaaggccaagctcgccctcgacaacatcgtcatgctccacaccaccgagaagggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcgccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatcggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccctctgcgaggtcctcaccctcgccaccggccccgccatgaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagcacgccgtctcccgcggctcctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgccgctacggcggctccctcgtccgctgccccctctcccgcaactccacccacgagatgtactgggtctccggcgcctccggcaacatcgtctcctccgtcaacaccatctccaagatgctcctcaaccgcttcaccacccgccaccgcaagcccacctacgagaaggacgtcgacctcggcgccggcacccgctccgtctccaccgagaccgagaagcccgacatgaccgtcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatgatcatgaccaccaccgccaactggctctgggccctcctcggcaagaagaagtccccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttctcccgcgagaactcctggtccggcgtcgagggcgagggcctccaccgcctcggctacatcctcgaggacatcgacaagcaggagggcgacctcatctacgccgacgacaccgccggctgggacacccgcatcaccgaggacgacctcctcaacgaggagctcatcaccgagcagatggccccccaccacaagaccctcgccaaggccatcttcaagctcacctaccagaacaaggtcgtcaaggtcctccgccccacccccaagggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctcaccgagtgcggcgtcgaccgcctcaagcgcatggccatctccggcgacgactgcgtcgtcaagcccctcgacgagcgcttctccacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgaccgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggactacgtcgactacatgcccgtcatgaagcgctactccgccccctccgagtccgagggcgtcctctga

SEQ ID NO: 13157 - RNA, 9867 nt, synthetic construct
  misc_feature 1..9867: note = derived and/or modified CDS sequence (opt2) from DENV-4__JN559740__SS-prME
  source 1..9867: mol_type = other RNA
tccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggcctccatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccgcgccgtcggcaacgacatctccaaccacggcgtcaccgccatgatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccgccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcatcatctcctccacccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggtccggcaaggagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgtctccgacctcaagtactcctggaagacctggggcaaggccaagatcttcacccccgaggcccgcaactccaccttcctcatcgacggccccgacacctccgagtgccccaacgagcgccgcgcctggaactccctcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagaaggcctccctcatcgaggtcaagacctgcctctggcccaagacccacaccctctggtccaacggcgtcctcgagtcccagatgctcatccccaagtcctacgccggccccttctcccagcacaactaccgccagggctacgccacccagaccgtcggcccctggcacctcggcaagctcgagatcgacttcggcgagtgccccggcaccaccgtcaccatccaggaggactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcaccgccggccagggcacctccgagaccttctccatgggcctcctctgcctcaccctcttcgtcgaggagtgcctccgccgccgcgtcacccgcaagcacatgatcctcgtcgtcgtcatcaccctctgcgccatcatcctcggcggcctcacctggatggacctcctccgcgccctcatcatgctcggcgacaccatgtccggccgcatcggcggccagatccacctcgccatcatggccgtcttcaagatgtcccccggctacgtcctcggcgtcttcctccgcaagctcacctcccgcgagaccgccctcatggtcatcggcatggccatgaccaccgtcctctccatcccccacgacctcatggagctcatcgacggcatctccctcggcctcatcctcctcaagatcgtcacccagttcgacaacacccaggtcggcaccctcgccctctccctcaccttcatccgctccaccatgcccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccgtcaccatgaccctctggtacatgtggcaggtcaagacccagcgctccggcgccctctgggacgtcccctcccccgccgccacccagaaggccgccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgcccccgctggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcaccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctcaagcccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccatcaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgccttctccctcatcaagaacgtccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagcacgccgtctcccgcggctcctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgcaagcacggcggcaacctcgtccgctgccccctctcccgcaactccacccacgagatgtactgggtctccggcgcctccggcaacatcgtctcctccgtcaacaccacctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatggtcatgaccaccaccgccaactggctctgggccctcctcggcaagaagaagaacccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggagatcgacaagaaggacggcgacctcatgtacgccgacgacaccgccggctgggacacccgcatcaccgaggacgacctccagaacgaggagctcatcaccgagcagatggccccccaccacaagatcctcgccaaggccatcttcaagctcacctaccagaacaaggtcgtcaaggtcctccgccccaccccccgcggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctcaaggagtgcggcgtcgaccgcctcaagcgcatggccatctccggcgacgactgcgtcgtcaagcccctcgacgagcgcttcggcacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgaccgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgtcatgaagcgctactccgccccctccgagtccgagggcgtcctctga

SEQ ID NO: 13158 - RNA, 9867 nt, synthetic construct
  misc_feature 1..9867: note = derived and/or modified CDS sequence (opt2) from DENV-4__JN559741__SS-prME
  source 1..9867: mol_type = other RNA
tccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggccctcatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccaccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctccgccacccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggtccggccgcgagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgcctccgacctcaagtactcctggaagacctggggcaaggccaagatcttcacccccgaggcccgcaactccaccttcctcatcgacggccccgacacctccgagtgccccaacgagcgccgcgcctggaactccttcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagcgcgcctccctcatcgaggtcaagacctgcctctggcccaagacccacaccctctggtccaacggcgtcctcgagtcccagatgctcatccccaagtcctacgccggccccttctcccagcacaactaccgccagggctacgccacccagaccgtcggcccctggcacctcggcaagctcgagatcgacttcggcgagtgccccggcaccaccgtcaccatccaggagaactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcaccgccggccagggcacctccgagaccttctccatgggcctcctctgcctcaccctcttcgtcgaggagtgcctccgccgccgcgtcacccgcaagcacatgatcctcgccgtcgtcatcaccctctgcgccatcatcctcggcggcctcacctggatggacctcctccgcgccctcatcatgctcggcgacaccatgtccggccgcatcggcggccagacccacctcgccatcatggccgtcttcaagatgtcccccggctacgtcctcggcgtcttcctccgcaagctcacctcccgcgagaccgccctcatggtcatcggcatggccatgaccaccaccctctccatcccccacgacctcatggagctcatcgacggcatctccctcggcctcatcctcctcaagatcgtcacccagttcgacaacacccaggtcggcaccctcgccctctccctcaccttcatccgctccaccatgtccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccatcaccatgaccctctggtacatgtggcaggtcaagacccagcgctccggcgccctctgggacgtcccctcccccgccgccacccagaaggccgccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgccccaagtggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcaccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccgccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagcacgccgtctcccgcggctcctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgcaagcacggcggcaacctcgtccgctgccccctctcccgcaactccacccacgagatgtactgggtctccggcgcctccggcaacatcgtctcctccgtcaacaccacctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatggtcatgaccaccaccgccaactggctctgggccctcctcggcaagaagaagaacccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggagatcgacaagaaggacggcgacctcatgtacgccgacgacaccgccggctgggacacccgcatcaccgaggacgacctccagaacgaggagctcatcaccgagcagatggccccccaccacaagatcctcgccaaggccatcttcaagctcacctaccagaacaaggtcgtcaaggtcctccgccccaccccccgcggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctccgcgagtgcggcgtcgaccgcctcaagcgcatggccatctccggcgacgactgcgtcgtcaagcccctcgacgagcgcttcggcacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgatcgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgtcatgaagcgctactccgccccctccgagtccgagggcgtcctctga

SEQ ID NO: 13159 - RNA, 9867 nt, synthetic construct
  misc_feature 1..9867: note = derived and/or modified CDS sequence (opt2) from DENV-4__JQ513334__SS-prME
  source 1..9867: mol_type = other RNA
tccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccatggaggtcgccctcctccgcacctactgcatcgaggcctccatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccgagaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcgagctccccgactacggcgagctcaccctcgactgcgagccccgctccggcatcgacttcaacgagatgatcctcatgaagatgaagaagaagacctggctcgtccacaagcagtggttcctcgacctccccctcccctgggccgccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctcctccatccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcgtcgccatcctcggcgagaccgcctgggacttcggctccgtcggcggcctcttcacctccctcggcaaggccgtccaccaggtcttcggctccgtctacaccaccatgttcggcggcgtctcctggatggtccgcatcctcatcggcctcctcgtcctctggatcggcaccaactcccgcaacacctccatggccatgacctgcatcgccgtcggcggcatcaccctcttcctcggcttcaccgtccaggccgacatgggctgcgtcgtctcctggtccggccgcgagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgtctccgacctcaagtactcctggaagacctggggcaaggccaagatcttcacccccgaggcccgcaactccaccttcctcatcgacggccccgacacctccgagtgccccaacgagcgccgcgcctggaactccctcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagaaggcctccctcatcgaggtcaagacctgcctctggcccaagacccacaccctctggtccaacggcgtcctcgagtcccagatgctcatccccaagtcctacgccggccccttctcccagcacaactaccgccagggctacgccacccagaccgtcggcccctggcacctcggcaagctcgagatcgacttcggcgagtgccccggcaccaccgtcaccatccaggaggactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcgccgccggccagggcacctccgagaccttctccatgggcctcctctgcctcaccctcttcgtcgaggagtgcctccgccgccgcgtcacccgcaagcacatgatcctcgccgtcgtcatcaccctctgcgccatcatcctcggcggcctcacctggatggacctcctccgcgccctcatcatgctcggcgacaccatgtccggccgcatcggcggccagacccacctcgccatcatggccgtcttcaagatgtcccccggctacgtcctcggcgtcttcctccgcaagctcacctcccgcgagaccgccctcatggtcatcggcatggccatgaccaccaccctctccatcccccacgacctcatggagctcatcgacggcatctccctcggcctcatcctcctcaagatcgtcacccagttcgacaacacccaggtcggcaccctcgccctctccctcaccttcatccgctccaccatgtccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccgtcaccatgaccctctggtacatgtggcaggtcaagacccagcgctccggcgccctctgggacgtcccctcccccgccgccacccagaaggccgccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgcccccgctggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcaccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcgccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagcacgccgtctcccgcggctcctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgcaagcacggcggcaacctcgtccgctgccccctctcccgcaactccacccacgagatgtactgggtctccggcgcctccggcaacatcgtctcctccgtcaacaccacctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatggtcatgaccaccaccgccaactggctctgggccctcctcggcaagaagaagaacccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggagatcgacaagaaggacggcgacctcatgtacgccgacgacaccgccggctgggacacccgcatcaccgaggacgacctccagaacgaggagctcatcaccgagcagatggccccccaccacaagatcctcgccaaggccatcttcaagctcacctaccagaacaaggtcgtcaaggtcctccgccccaccccccgcggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctccgcgagtgcggcgtcgaccgcctcaagcgcatggccatctccggcgacgactgcgtcgtcaagcccctcgacgagcgcttcggcacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgatcgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgtcatgaagcgctactccgccccctccgagtccgagggcgtcctctga

SEQ ID NO: 13160 - RNA, 9867 nt, synthetic construct
  misc_feature 1..9867: note = derived and/or modified CDS sequence (opt2) from DENV-4__JQ513336__SS-prME
  source 1..9867: mol_type = other RNA
tccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggcctccatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccgagaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcgagctccccgactacggcgagctcaccctcgactgcgagccccgctccggcatcgacttcaacgagatgatcctcatgaagatgaagaagaagacctggctcgtccacaagcagtggttcctcgacctccccctcccctgggccgccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctcctccatccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatggtccgcatcctcatcggcctcctcgtcctctggatcggcaccaactcccgcaacacctccatggccatgacctgcatcgccgtcggcggcatcaccctcttcctcggcttcaccgtccaggccgacatgggctgcgtcgtctcctggtccggccgcgagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgtctccgacctcaagtactcctggaagacctggggcaaggccaagatcttcacccccgaggcccgcaactccaccttcctcatcgacggccccgacacctccgagtgccccaacgagcgccgcgcctggaactccctcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagaaggcctccctcatcgaggtcaagacctgcctctggcccaagacccacaccctctggtccaacggcgtcctcgagtcccagatgctcatccccaagtcctacgccggccccttctcccagcacaactaccgccagggctacgccacccagaccgtcggcccctggcacctcggcaagctcgagatcgacttcggcgagtgccccggcaccaccgtcaccatccaggaggactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcgccgccggccagggcacctccgagaccttctccatgggcctcctctgcctcaccctcttcgtcgaggagtgcctccgccgccgcgtcacccgcaagcacatgatcctcgccgtcgtcatcaccctctgcgccatcatcctcggcggcctcacctggatggacctcctccgcgccctcatcatgctcggcgacaccatgtccggccgcatcggcggccagacccacctcgccatcatggccgtcttcaagatgtcccccggctacgtcctcggcgtcttcctccgcaagctcacctcccgcgagaccgccctcatggtcatcggcatggccatgaccaccaccctctccatcccccacgacctcatggagctcatcgacggcatctccctcggcctcatcctcctcaagatcgtcacccagttcgacaacacccaggtcggcaccctcgccctctccctcaccttcatccgctccaccatgtccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccgtcaccatgaccctctggtacatgtggcaggtcaagacccagcgctccggcgccctctgggacgtcccctcccccgccgccacccagaaggccgccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgcccccgctggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcaccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcgccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagcacgccgtctcccgcggctcctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgcaagcacggcggcaacctcgtccgctgccccctctcccgcaactccacccacgagatgtactgggtctccggcgcctccggcaacatcgtctcctccgtcaacaccacctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatggtcatgaccaccaccgccaactggctctgggccctcctcggcaagaagaagaacccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggagatcgacaagaaggacggcgacctcatgtacgccgacgacaccgccggctgggacacccgcatcaccgaggacgacctccagaacgaggagctcatcaccgagcagatggccccccaccacaagatcctcgccaaggccatcttcaagctcacctaccagaacaaggtcgtcaaggtcctccgccccaccccccgcggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctccgcgagtgcggcgtcgaccgcctcaagcgcatggccatctccggcgacgactgcgtcgtcaagcccctcgacgagcgcttcggcacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgatcgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgtcatgaagcgctactccgccccctccgagtccgagggcgtcctctga

SEQ ID NO: 13161 - RNA, 9867 nt, synthetic construct
  misc_feature 1..9867: note = derived and/or modified CDS sequence (opt2) from DENV-4__JQ513338__SS-prME
  source 1..9867: mol_type = other RNA
tccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggccctcatctccaacatcaccaccgccacccgctgccccacccagggcgagccctacctcaaggaggagcaggagcagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcaacacccccgccgtcggcaacgacacctccaaccacggcgtcaccgcccccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccaccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacgagaaccacatgttcgccggccacctcaagtgcaaggtccgcatgggcaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctccgccacccccctcgccgagaacaccaactccgtcaccaacatcgagctcgagccccccttcggcgaccgctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggtccggccgcgagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgcctccgacctcaagtactcctggaagacctggggcaaggccaagatcttcacccccgaggcccgcaactccaccttcctcatcgacggccccgacacctccgagtgccccaacgagcgccgcgcctggaactccttcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagcgcgcctccctcatcgaggtcaagacctgcctctggcccaagacccacaccctctggtccaacggcgtcctcgagtcccagatgctcatccccaagtcctacgccggccccttctcccagcacaactaccgccagggctacgccacccagaccgtcggcccctggcacctcggcaagctcgagatcgacttcggcgagtgccccggcaccaccgtcaccatccaggagaactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcaccgccggccagggcacctccgagaccttctccatgggcctcctctgcctcaccctcttcgtcgaggagtgcctccgccgccgcgtcacccgcaagcacatgatcctcgccgtcgtcatcaccctctgcgccatcatcctcggcggcctcacctggatggacctcctccgcgccctcatcatgctcggcgacaccatgtccggccgcatcggcggccagacccacctcgccatcatggccgtcttcaagatgtcccccggctacgtcctcggcgtcttcctccgcaagctcacctcccgcgagaccgccctcatggtcatcggcatggccatgaccaccaccctctccatcccccacgacctcatggagctcatcgacggcatctccctcggcctcatcctcctcaagatcgtcacccagttcgacaacacccaggtcggcaccctcgccctctccctcaccttcatccgctccaccatgtccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccatcaccatgaccctctggtacatgtggcaggtcaagacccagcgctccggcgccctctgggacgtcccctcccccgccgccacccagaaggccgccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgccccaagtggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcaccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagcacgccgtctcccgcggctcctccaagatccgctggatcgtcgagcgcggcatggtcaagcccaagggcaaggtcatcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgcaagcacggcggcaacctcgtccgctgccccctctcccgcaactccacccacgagatgtactgggtctccggcgcctccggcaacatcgtctcctccgtcaacaccacctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatggtcatgaccaccaccgccaactggctctgggccctcctcggcaagaagaagaacccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggagatcgacaagaaggacggcgacctcatgtacgccgacgacaccgccggctgggacacccgcatcaccgaggacgacctccagaacgaggagctcatcaccgagcagatggccccccaccacaagatcctcgccaaggccatcttcaagctcacctaccagaacaaggtcgtcaaggtcctccgccccaccccccgcggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctccgcgagtgcggcgtcgaccgcctcaagcgcatggccatctccggcgacgactgcgtcgtcaagcccctcgacgagcgcttcggcacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgatcgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgtcatgaagcgctactccgccccctccgagtccgagggcgtcctctga

SEQ ID NO: 13162 - RNA, 9867 nt, synthetic construct
  misc_feature 1..9867: note = derived and/or modified CDS sequence (opt2) from DENV-4__JQ513339__SS-prME
  source 1..9867: mol_type = other RNA
tccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggccctcatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccaccggcgccgacacctccgaggtccactggaactacaaggagcgcatggccaccttcaaggtcccccacgccaagcgccaggacgtcaccctcctcggctcccaggagggcgccatgcactccgccctcgccggcgccaccgaggtcgactccggcgacgagaaccacatgttcgccggccacctcaagtgcaaggtccgcatgggcaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcctctccgccacccccctcgccgagaacaccaactccgtcaccaacatcgagctcgagccccccttcggcgactcctacatcgtcatcggcgtcggcaactccgccctcaccctccactggttcaccaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggtccggccgcgagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgcctccgacctcaagtactcctggaagacctggggcaaggccaagatcttcacccccgaggcccgcaactccaccttcctcatcgacggccccgacacctccgagtgccccaacgagcgccgcgcctggaactccttcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagcgcgcctccctcatcgaggtcaagacctgcctctggcccaagacccacaccctctggtccaacggcgtcctcgagtcccagatgctcatccccaagtcctacgccggccccttctcccagcacaactaccgccagggctacgccacccagaccgtcggcccctggcacctcggcaagctcgagatcgacttcggcgagtgccccggcaccaccgtcaccatccaggagaactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcaccgccggccagggcacctccgagaccttctccatgggcctcctctgcctcaccctcttcgtcgaggagtgcctccgccgccgcgtcacccgcaagcacatgatcctcgccgtcgtcatcaccctctgcgccatcatcctcggcggcctcacctggatggacctcctccgcgccctcatcatgctcggcgacaccatgtccggccgcatcggcggccagacccacctcgccatcatggccgtcttcaagatgtcccccggctacgtcctcggcgtcttcctccgcaagctcacctcccgcgagaccgccctcatggtcatcggcatggccatgaccaccaccctctccatcccccacgacctcatggagctcatcgacggcatctccctcggcctcatcctcctcaagatcgtcacccagttcgacaacacccaggtcggcaccctcgccctctccctcaccttcatccgctccaccatgtccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccatcaccatgaccctctggtacatgtggcaggtcaagacccagcgctccggcgccctctgggacgtcccctcccccgccgccacccagaaggccgccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgccccaagtggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcaccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagcacgccgtctcccgcggctcctccaagatccgctggatcgtcgagcgcggcatggtcaagcccaagggcaaggtcatcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgcaagcacggcggcaacctcgtccgctgccccctctcccgcaactccacccacgagatgtactgggtctccggcgcctccggcaacatcgtctcctccgtcaacaccacctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatggtcatgaccaccaccgccaactggctctgggccctcctcggcaagaagaagaacccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggagatcgacaagaaggacggcgacctcatgtacgccgacgacaccgccggctgggacacccgcatcaccgaggacgacctccagaacgaggagctcatcaccgagcagatggccccccaccacaagatcctcgccaaggccatcttcaagctcacctaccagaacaaggtcgtcaaggtcctccgccccaccccccgcggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctccgcgagtgcggcgtcgaccgcctcaagcgcatggccatctccggcgacgactgcgtcgtcaagcccctcgacgagcgcttcggcacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgatcgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgtcatgaagcgctactccgccccctccgagtccgagggcgtcctctga

SEQ ID NO: 13163 - RNA, 9867 nt, synthetic construct
  misc_feature 1..9867: note = derived and/or modified CDS sequence (opt2) from DENV-4__JQ513343__SS-prME
  source 1..9867: mol_type = other RNA
tccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggccctcatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccaccggcgccgacacctccgaggtccactggaactacaaggagcgcatggagaccttcaaggtcccccacgccaagcgccaggacgtcaccctcctcggctcccaggagggcgccatgcactccgccctcgccggcgccaccgaggtcgactccggcgacgagaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctccgccacccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggtccggccgcgagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgcctccgacctcaagtactcctggaagacctggggcaaggccaagatcttcacccccgaggcccgcaactccaccttcctcatcgacggccccgacacctccgagtgccccaacgagcgccgcgcctggaactccttcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagcgcgcctccctcatcgaggtcaagacctgcctctggcccaagacccacaccctctggtccaacggcgtcctcgagtcccagatgctcatccccaagtcctacgccggccccttctcccagcacaactaccgccagggctacgccacccagaccgtcggcccctggcacctcggcaagctcgagatcgacttcggcgagtgccccggcaccaccgtcaccatccaggagaactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcaccgccggccagggcacctccgagaccttctccatgggcctcctctgcctcaccctcttcgtcgaggagtgcctccgccgccgcgtcacccgcaagcacatgatcctcgccgtcgtcatcaccctctgcgccatcatcctcggcggcctcacctggatggacctcctccgcgccctcatcatgctcggcgacaccatgtccggccgcatcggcggccagacccacctcgccatcatggccgtcttcaagatgtcccccggctacgtcctcggcgtcttcctccgcaagctcacctcccgcgagaccgccctcatggtcatcggcatggccatgaccaccaccctctccatcccccacgacctcatggagctcatcgacggcatctccctcggcctcatcctcctcaagatcgtcacccagttcgacaacacccaggtcggcaccctcgccctctccctcaccttcatccgctccaccatgtccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccatcaccatgaccctctggtacatgtggcaggtcaagacccagcgctccggcgccctctgggacgtcccctcccccgccgccacccagaaggccgccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgccccaagtggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcaccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagcacgccgtctcccgcggctcctccaagatccgctggatcgtcgagcgcggcatggtcaagcccaagggcaaggtcatcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgcaagcacggcggcaacctcgtccgctgccccctctcccgcaactccacccacgagatgtactgggtctccggcgcctccggcaacatcgtctcctccgtcaacaccacctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatggtcatgaccaccaccgccaactggctctgggccctcctcggcaagaagaagaacccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggagatcgacaagaaggacggcgacctcatgtacgccgacgacaccgccggctgggacacccgcatcaccgaggacgacctccagaacgaggagctcatcaccgagcagatggccccccaccacaagatcctcgccaaggccatcttcaagctcacctaccagaacaaggtcgtcaaggtcctccgccccaccccccgcggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctccgcgagtgcggcgtcgaccgcctcaagcgcatggccatctccggcgacgactgcgtcgtcaagcccctcgacgagcgcttcggcacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgatcgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgtcatgaagcgctactccgccccctccgagtccgagggcgtcctctga

SEQ ID NO: 13164 - RNA, 9867 nt, synthetic construct
  misc_feature 1..9867: note = derived and/or modified CDS sequence (opt2) from DENV-4__KT276273__SS-prME
  source 1..9867: mol_type = other RNA
tccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggccgccccaccctcgacttcgagctcaccaagaccaccgccaaggaggtcgccctcctccgcacctactgcatcgaggcctccatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcgagctccccgactacggcgagctcaccctcgactgcgagccccgctccggcatcgacttcaacgagatgatcctcatgaagatgaacaagaagacctggctcgtccacaagcagtggttcctcgacctccccctcccctggaccgccggcgccgacacctccgaggtccactggaacaacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcatcggccgcgtcatctcctccatccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggtccggccgcgagctcaagtgcggctccggcatcttcgtcatcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgcctccgacctcaagtactcctggaagacctggggcaaggccaagatcttcacccccgaggcccgcaactccaccttcctcatcgacggccccgacacctccgagtgccccaacgagcgccgcgcctggaactccctcgaggtcgaggactacggcttcggcatgttcaccaccaacatctggatgaagttccgcgagggctcctccgagatgtgcgaccaccgcctcatgtccgccgccatcaaggaccagaaggccgtccacgccgacatgggctactggatcgagtcctccaagaaccagacctggcagatcgagaaggcctccctcatcgaggtcaagacctgcctctggcccaagacccacaccctctggtccaacggcgtcctcgagtcccagatgctcatccccaagtcctacgccggccccttctcccagcacaactaccgccagggctacgccacccagatcgccggcccctggcacctcggcaagctcgagatcgacttcggcgagtgccccggcaccaccgtcaccatccaggaggactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcgccgccggccagggcacctccgagaccttctccatgggcctcctctgcctcaccctcttcgtcgaggagtgcctccgccgccgcgtcacccgcaagcacatgatcctcgtcgtcgtcatcaccttctgcgccatcatcctcggcggcctcacctggatggacctcctccgcgccctcatcatgctcggcgacaccatgtccggccgcatcggcggccagatccacctcgccatcatggccgtcttcaagatgtcccccggctacgtcctcggcgtcttcctccgcaagctcacctcccgcgagaccgccctcatggtcatcggcatggccatgaccaccgtcctctccatcccctacgacctcatggagctcatcgacggcatctccctcggcctcatcctcctcaagatcgtcacccagttcgacaacacccaggtcggcaccctcgccctctccctcaccttcatccgctccaccatgcccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccgtcaccatgaccctctggtacatgtggcaggtcaagacccagcgctccggcgccctctgggacgtcccctcccccgccgccacccagaaggccgccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgcccccgctggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcaccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagcacgccgtctcccgcggctcctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgcaagcacggcggcaacctcgtccgctgccccctctcccgcaactccacccacgagatgtactgggtctccggcgcctccggcaacatcgtctcctccgtcaacaccacctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatggtcatgaccaccaccgccaactggctctgggccctcctcggcaagaagaagaacccccgcctctgcaccaaggaggagttcatctccaaggtccgcgccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggagatcgacaagaaggacggcgacctcatgtacgccgacgacaccgccggctgggacacccgcatcaccgaggacgacctccagaacgaggagctcatcaccgagcagatggccccccaccacaagatcctcgccaaggccatcttcaagctcacctaccagaacaaggtcgtcaaggtcctccgccccaccccccgcggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctccgcgagtgcggcgtcgaccgcctcaagcgcatggccatctccggcgacgactgcgtcgtcaagcccctcgacgagcgcttcgccacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctcaaggagaccgcctgcctcgccaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgatcgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacatggactacatgcccgtcatgcgccgctactccgccccctccgagtccgagggcgtcctctga

SEQ ID NO: 13165 - RNA, 9867 nt, synthetic construct
  misc_feature 1..9867: note = derived and/or modified CDS sequence (opt2) from DENV-4__KU523872__SS-prME
  source 1..9867: mol_type = other RNA
tccaccatgaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcccacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggcctccatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccgccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcatcatctcctccacccccttcgccgagaacaccaactccgtcaccaacatcgagctcgagccccccttcggcgactcctacatcgtcatcggcgtcggcgactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggaacggcaaggagctcaagtgcggcaacggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgtcaacgacctcaagtactcctggaagacctggggcaaggccaagatcttcacccccgaggcccgcaactccaccttcctcatcgacggccccgacacctccgagtgccccaacgagcgccgcgcctggaacttcttcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagaaggcctccctcatcgaggtcaagacctgcctctggcccaagacccacaccctctggtccaacggcgtcctcgagtcccagatgctcatcccccgctcctacgccggccccttctcccagcacaactaccgccagggctacgccacccagaccgccggcccctggcacctcggcaagctcgagatcgacttcggcgagtgccccggcaccaccgtcaccatccaggaggactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcaccgccggccagggcacctccgagaccttctccatgggcctcctctgcctcaccctcttcgtcgaggagtgcctccgccgccgcgtcacccgcaagcacatgatcctcgtcgtcgtcatcaccttctgcgccatcatcctcggcggcctcacctgggtcgacctcctccgcgccctcatcatgctcggcgacaccatgtccggccgcatcggcggccagatccacctcgccatcatggccgtcttcaagatgtcccccggctacgtcctcggcgtcttcctccgcaagctcacctcccgcgagaccgccctcatggtcatcggcatggccatgaccaccgtcttctccatcccccacgacctcatggagctcatcgacggcatctccctcggcctcatcctcctcaagatcgtcacccacttcgacaacacccaggtcggcaccctcgccctctccctcaccttcatccgctccaccacccccctcgtcatggcctggcgcaccatcatggccgtcttcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccgtcatcgaggtcaagcaggacgaggacggctccttctccatccgcgacgtcgaggagaccaacatgatcaccctcctcgtcaagctcgccctcatcaccgtctccggcctctaccccctcgccatccccgtcaccatggccatctggtacatctggcaggtcaagacccagcgctccggcgccctctgggacgtcccctcccccgccgccacccagaaggccaccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggaagctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaacaagaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctgctccgtcgccgcccgcggctacatctccacccgcgtcgagatgggcgaggccgccgccatcttcatgaccgccaccccccccggctccatcgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagcgcgtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctccgcaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgccccaagtggctcgacgcccgcgtctacgccgaccccatggccctcaaggacttcaaggagttcgcctccggccgcaagtccatcaccctcgacatcctcaccgagatcgccaccctccccacctacctctcctccaaggccaagctcgccctcgacaacatcgtcatgctccacaccaccgagaagggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcgccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcgtcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatcggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgtcggccagctcctcctcatgcgcaccacctgggccctctgcgaggtcctcaccctcgccaccggccccatcatgaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctccgcgacggctccaagaccaagcacgccgtctcccgcggctcctccaagatccgctggatcgtcgagcgcggcatgatcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggcaagaccctccgcgtcctcaagatggtcgagccctggctctcctccaagcccgagttctgcatcaaggtcctcaacccctacatgcccaccgtcatcgaggagctcgagaagctccagcgccgccacggcggctccctcgtccgctgccccctctcccgcaactccacccacgagatgtactgggtctccggcgcctccggcaacatcgtctcctccgtcaacaccatctccaagatgctcctcaaccgcttcaccacccgctaccgcaagcccacctacgagaaggacgtcgacctcggcgccggcacccgctccgtctccaccgagaccgagaagcccgacatgaccatcatcggccgccgcctccagcgcctccgcgaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcgtccccatggtcacccagctcgccatgaccgacaccacccccttcggccagcagcgcgtcttcaaggagaaggtcgacacccgcaccccccagcccaagcccggcacccgcaagatcatgaccaccaccgccaactggctctgggccctcctcggcaagaagaagtccccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggccgctgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttctcccgcgagaactcctggtccggcgtcgagggcgagggcctccaccgcctcggctacatcctcgaggacatcgacaagaaggacggcgacctcatctacgccgacgacaccgccggctgggacacccgcatcaccgaggacgacctcctcaacgaggagctcatcaccgagcagatggccccccaccacaagaccctcgccaaggccatcttcaagctcacctaccagaacaaggtcgtcaaggtcctccgccccacccccaagggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccgagggcctcaaggagcgcgtcgagaagtggctcaaggagtgcggcgtcgaccgcctcaagcgcatggccatctccggcgacgactgcgtcgtcaagcccctcgacgagcgcttctccacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgaccgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgccatgaagcgctactccgcccccttcgagtccgagggcgtcctctga

SEQ ID NO: 13166 - RNA, 9867 nt, synthetic construct
  misc_feature 1..9867: note = derived and/or modified CDS sequence (opt2) from DENV-4__KP140942__SS-prME
  source 1..9867: mol_type = other RNA
tccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggccgccccaccctcgacttcgagctcaccaagaccaccgccaaggaggtcgccctcctccgcacctactgcatcgaggcctccatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcgagctccccgactacggcgagctcaccctcgactgcgagccccgctccggcatcgacttcaacgagatgatcctcatgaagatgaacaagaagacctggctcgtccacaagcagtggttcctcgacctccccctcccctggaccgccggcgccgacacctccgaggtccactggaacaacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcatcggccgcgtcatctcctccatccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggtccggccgcgagctcaagtgcggctccggcatcttcgtcatcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgcctccgacctcaagtactcctggaagacctggggcaaggccaagatcttcacccccgaggcccgcaactccaccttcctcatcgacggccccgacacctccgagtgccccaacgagcgccgcgcctggaactccctcgaggtcgaggactacggcttcggcatgttcaccaccaacatctggatgaagttccgcgagggctcctccgagatgtgcgaccaccgcctcatgtccgccgccatcaaggaccagaaggccgtccacgccgacatgggctactggatcgagtcctccaagaaccagacctggcagatcgagaaggcctccctcatcgaggtcaagacctgcctctggcccaagacccacaccctctggtccaacggcgtcctcgagtcccagatgctcatccccaagtcctacgccggccccttctcccagcacaactaccgccagggctacgccacccagatcgccggcccctggcacctcggcaagctcgagatcgacttcggcgagtgccccggcaccaccgtcaccatccaggaggactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcgccgccggccagggcacctccgagaccttctccatgggcctcctctgcctcaccctcttcgtcgaggagtgcctccgccgccgcgtcacccgcaagcacatgatcctcgccgtcgtcatcaccctctgcgccatcatcctcggcggcctcacctggatggacctcctccgcgccctcatcatgctcggcgacaccatgtccggccgcatgggcggccagacccacctcgccatcatggccgtcttcaagatgtcccccggctacgtcctcggcgtcttcctccgcaagctcacctcccgcgagaccgccctcatggtcatcggcatggccatgaccaccaccctctccatcccccacgacctcatggagctcatcgacggcatctccctcggcctcatcctcctcaagatcgtcacccagttcgacaacacccaggtcggcaccctcgccctctccctcaccttcatccgctccaccatgtccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctccaagcgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccgtcaccatgaccctctggtacatgtggcaggtcaagacccagcgctccggcgccctctgggacgtcccctcccccgccgccacccagaaggccgccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgcccccgctggctcgacgcccgcgtctacgccgaccccatggccctcaaggacttcaaggagttcgcctccggccgcaagtccctcaccctcgacatcctcaccgagatcgcctccctccccacctacctctcctcccgcgccaagctcgccctcgacaacatcgtcatgctccacaccaccgagcgcggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcaccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagcacgccgtctcccgcggctcctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgcaagcacggcggcaacctcgtccgctgccccctctcccgcaactccacccacgagatgtactgggtctccggcgcctccggcaacatcgtctcctccgtcaacaccacctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatggtcatgaccaccaccgccaactggctctgggccctcctcggcaagaagaagaacccccgcctctgcaccaaggaggagttcatctccaaggtccgcgccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggagatcgacaagaaggacggcgacctcatgtacgccgacgacaccgccggctgggacacccgcatcaccgaggacgacctccagaacgaggagctcatcaccgagcagatggccccccaccacaagatcctcgccaaggccatcttcaagctcacctaccagaacaaggtcgtcaaggtcctccgccccaccccccgcggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctccgcgagtgcggcgtcgaccgcctcaagcgcatggccatctccggcgacgactgcgtcgtcaagcccctcgacgagcgcttcgccacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctcaaggagaccgcctgcctcgccaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgatcgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacatggactacatgcccgtcatgcgccgctactccgccccctccgagtccgagggcgtcctctga

SEQ ID NO: 13167 - RNA, 9867 nt, synthetic construct
  misc_feature 1..9867: note = derived and/or modified CDS sequence (opt2) from DENV-4__KU523871__SS-prME
  source 1..9867: mol_type = other RNA
tccaccatgaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagaacggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcatcgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggcctccatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccgccggcgccgacacctccgaggtccactggaaccacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcatcatctcctccacccccttcgccgagaacaccaactccgtcaccaacatcgagctcgagccccccttcggcgactcctacatcgtcatcggcgtcggcgagtccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatggtccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggtccggcaaggagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcacccgcggcaagcgcgccctcaccccccccgtcaacgacctcaagtactcctggaagacctggggcaaggccaagatcttcacccccgaggcccgcaactccaccttcctcatcgacggccccgacacctccgagtgccccaacgagcgccgcgcctggaacttcttcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagaaggcctccctcatcgaggtcaagacctgcctctggcccaagacccacaccctctggtccaacggcgtcctcgagtcccagatgctcatcccccgctcctacgccggccccttctcccagcacaactaccgccagggctacgccacccagaccgtcggcccctggcacctcggcaagctcgagatcgacttcggcgagtgccccggcaccaccgtcgccatccgcgaggactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggccaccgccggccagggcacctccgagaccttctccatgggcctcctctgcctcaccctcttcgtcgaggagtgcctccgccgccgcgtcacccgcaagcacatgatcctcgtcgtcgtcatcaccttctgcgccatcatcctcggcggcctcacctggatggacctcctccgcgccctcatcatgctcggcgacaccatgtccggccgcatcggcggccagatccacctcgccatcatggccgtcttcaagatgtcccccggctacgtcctcggcgtcttcctccgcaagctcacctcccgcgagaccgccctcatggtcatcggcatggccatgaccaccgtcttctccatcccccacgacctcatggagctcatcgacggcatctccctcggcctcatcctcctcaagatcgtcacccacttcgacaacacccaggtcggcaccctcgccctctccctcaccttcctccgctccaccacccccctcgtcatggcctggcgcaccatcatggccgtcttcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatgaccctcctcgtcaagctcgccctcatcaccgtctccggcctctaccccctcgccatccccgtcaccatggccctctggtacatctggcaggtcaagacccagcgctccggcgccctctgggacgtcccctcccccgccgccacccagaaggccaccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaacaagaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctgctccgtcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagcgcgtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgaagcgcggcgacctccccgtctggctctcctacaaggtcgcctccgccggcatctcctacaaggaccgcgagtggtgcttcaccggcgagcgcaacaaccagatcctcgaggagaacatggaggtcgagatctggaccaaggagggcgagaagaagaagctccgccccaagtggctcgacgcccgcgtctacgccgaccccatggccctcaaggacttcaaggagttcgcctccggccgcaagtccatcaccctcgacatcctcaccgagatcgcctccctccccacctacctctcctccaaggccaagctcgccctcgacaacatcatcatgctccacaccaccgagaagggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcgccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatcggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccctctgcgaggtcctcaccctcgccaccggccccgccatgaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagcacgccgtctcccgcggctcctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgccgccacggcggctccctcgtccgctgccccctctcccgcaactccacccacgagatgtactgggtctccggcgcctccggcaacatcgtctcctccgtcaacaccatctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccgcgaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcgtccccatggtcacccagctcgccatgaccgacaccacccccttcggccagcagcgcgtcttcaaggagaaggtcgacacccgcaccccccagcccaagcccggcacccgcatgatcatgaccaccaccgccaactggctctggaccctcctcggcaagaagaagtccccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatgtggtacatgtggctcggcgcccgcttcctcgagttcgaggccctcggcttcctcaacgaggaccactggttctcccgcgagaactcctggtccggcgtcgagggcgagggcctccaccgcctcggctacatcctcgaggacatcgacaagaaggacggcgacctcatctacgccgacgacaccgccggctgggacacccgcatcaccgaggacgacctcctcaacgaggagctcatcaccgagcagatggccccccaccacaagaccctcgccaaggccatcttcaagctcacctaccagaacaaggtcgtcaaggtcctccgccccacccccaagggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctcaccgagtgcggcgtcgaccgcctcaagcgcatggccatctccggcgacgactgcgtcgtcaagcccctcgacgagcgcttctccacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgaccgacaagacccccgtctactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggactacgtcgactacatgcccatcatgaagcgctactccgccccctccgagtccgagggcgtcctctga

SEQ ID NO: 13168 - RNA, 9867 nt, synthetic construct
  misc_feature 1..9867: note = derived and/or modified CDS sequence (opt2) from DENV-4__HQ332175__SS-prME
  source 1..9867: mol_type = other RNA
tccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggccctcatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccaccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctccgccacccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggtccggccgcgagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgcctccgacctcaagtactcctggaagacctggggcaaggccaagatcttcacccccgaggcccgcaactccaccttcctcatcgacggccccgacacctccgagtgccccaacgagcgccgcgcctggaactccttcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagcgcgcctccctcatcgaggtcaagacctgcctctggcccaagacccacaccctctggtccaacggcgtcctcgagtcccagatgctcatccccaagtcctacgccggccccttctcccagcacaactaccgccagggctacgccacccagaccgtcggcccctggcacctcggcaagctcgagatcgacttcggcgagtgccccggcaccaccgtcaccatccaggagaactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcaccgccggccagggcacctccgagaccttctccatgggcctcctctgcctcaccctcttcgtcgaggagtgcctccgccgccgcgtcacccgcaagcacatgatcctcgccgtcgtcatcaccctctgcgccatcatcctcggcggcctcacctggatggacctcctccgcgccctcatcatgctcggcgacaccatgtccggccgcatcggcggccagacccacctcgccatcatggccgtcttcaagatgtcccccggctacgtcctcggcgtcttcctccgcaagctcacctcccgcgagaccgccctcatggtcatcggcatggccatgaccaccaccctctccatcccccacgacctcatggagctcatcgacggcatctccctcggcctcatcctcctcaagatcgtcacccagttcgacaacacccaggtcggcaccctcgccctctccctcaccttcatccgctccaccatgtccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgtcgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccatcaccatgaccctctggtacatgtggcaggtcaagacccagcgctccggcgccctctgggacgtcccctcccccgccgccacccagaaggccgccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgccccaagtggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcaccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagcacgccgtctcccgcggctcctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgcaagcacggcggcaacctcgtccgctgccccctctcccgcaactccacccacgagatgtactgggtctccggcgcctccggcaacatcgtctcctccgtcaacaccacctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatggtcatgaccaccaccgccaactggctctgggccctcctcggcaagaagaagaacccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggagatcgacaagaaggacggcgacctcatgtacgccgacgacaccgccggctgggacacccgcatcaccgaggacgacctccagaacgaggagctcatcaccgagcagatggccccccaccacaagatcctcgccaaggccatcttcaagctcacctaccagaacaaggtcgtcaaggtcctccgccccaccccccgcggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctccgcgagtgcggcgtcgaccgcctcaagcgcatggccatctccggcgacgactgcgtcgtcaagcccctcgacgagcgcttcggcacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgatcgacaagacccccgtccactcctgggaggacatcccctacctcggcaagcgcgaggacctctggtgcggctccctcatcggcctctcctcccgcgccacctgggccaagaacatccacaccgccatcgcccaggtccgcaacctcatcggcaaggaggagtacgtcgactacatgcccgtcatgaagcgctactccgccccctccgagtccgagggcgtcctctga

SEQ ID NO: 13169 - RNA, 9867 nt, synthetic construct
  misc_feature 1..9867: note = derived and/or modified CDS sequence (opt2) from DENV-4__HQ332172__SS-prME
  source 1..9867: mol_type = other RNA
tccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccgcctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggccctcatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccaccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctccgccacccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggtccggccgcgagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgcctccgacctcaagtactcctggaagacctggggcaaggccaagatcttcacccccgaggcccgcaactccaccttcctcatcgacggccccgacacctccgagtgccccaacgagcgccgcgcctggaactccttcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagcgcgcctccctcatcgaggtcaagacctgcctctggcccaagacccacaccctctggtccaacggcgtcctcgagtcccagatgctcatccccaagtcctacgccggccccttctcccagcacaactaccgccagggctacgccacccagaccgtcggcccctggcacctcggcaagctcgagatcgacttcggcgagtgccccggcaccaccgtcaccatccaggagaactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcaccgccggccagggcacctccgagaccttctccatgggcctcctctgcctcaccctcttcgtcgaggagtgcctccgccgccgcgtcacccgcaagcacatgatcctcgccgtcgtcatcaccctctgcgccatcatcctcggcggcctcacctggatggacctcctccgcgccctcatcatgctcggcgacaccatgtccggccgcatcggcggccagacccacctcgccatcatggccgtcttcaagatgtcccccggctacgtcctcggcgtcttcctccgcaagctcacctcccgcgagaccgccctcatggtcatcggcatggccatgaccaccaccctctccatcccccacgacctcatggagctcatcgacggcatctccctcggcctcatcctcctcaagatcgtcacccagttcgacaacacccaggtcggcaccctcgccctctccctcaccttcatccgctccaccatgtccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccatcaccatgaccctctggtacatgtggcaggtcaagacccagcgctccggcgccctctgggacgtcccctcccccaccgccacccagaaggccgccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgccccaagtggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcaccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccatcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgccctctgcgccggccagctcctcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagcacgccgtctcccgcggctcctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgcaagcacggcggcaacctcgtccgctgccccctctcccgcaactccacccacgagatgtactgggtctccggcgcctccggcaacatcgtctcctccgtcaacaccacctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatggtcatgaccaccaccgccaactggctctgggccctcctcggcaagaagaagaacccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggagatcgacaagaaggacggcgacctcatgtacgccgacgacaccgccggctgggacacccgcatcaccgaggacgacctccagaacgaggagctcatcaccgagcagatggccccccaccacaagatcctcgccaaggccatcttcaagctcacctaccagaacaaggtcgtcaaggtcctccgccccaccccccgcggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctccgcgagtgcggcgtcgaccgcctcaagcgcatggccatctccggcgacgactgcgtcgtcaagcccctcgacgagcgcttcggcacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgatcgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgtcatgaagcgctactccgccccctccgagtccgagggcgtcctctga

SEQ ID NO: 13170 - RNA, 9867 nt, synthetic construct
  misc_feature 1..9867: note = derived and/or modified CDS sequence (opt2) from DENV-4__HQ332176__SS-prME
  source 1..9867: mol_type = other RNA
tccaccatcaccctcctctgcctcatccccaccgtcatggccttccacctctccacccgcgacggcgagcccctcatgatcgtcgcccgccacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggccctcatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccaccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctccgccacccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggtccggccgcgagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgcctccgacctcaagtactcctggaagacctggggcaaggccaagatcttcacccccgaggcccgcaactccaccttcctcatcgacggccccgacacctccgagtgccccaacgagcgccgcgcctggaactccttcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagcgcgcctccctcatcgaggtcaagacctgcctctggcccaagacccacaccctctggtccaacggcgtcctcgagtcccagatgctcatccccaagtcctacgccggccccttctcccagcacaactaccgccagggctacgccacccagaccgtcggcccctggcacctcggcaagctcgagatcgacttcggcgagtgccccggcaccaccgtcaccatccaggagaactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcaccgccggccagggcacctccgagaccttctccatgggcctcctctgcctcaccctcttcgtcgaggagtgcctccgccgccgcgtcacccgcaagcacatgatcctcgccgtcgtcatcaccctctgcgccatcatcctcggcggcctcacctggatggacctcctccgcgccctcatcatgctcggcgacaccatgtccggccgcatcggcggccagacccacctcgccatcatggccgtcttcaagatgtcccccggctacgtcctcggcgtcttcctccgcaagctcacctcccgcgagaccgccctcatggtcatcggcatggccatgaccaccaccctctccatcccccacgacctcatggagctcatcgacggcatctccctcggcctcatcctcctcaagatcgtcacccagttcgacaacacccaggtcggcaccctcgccctctccctcaccttcatccgctccaccatgtccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccatcaccatgaccctctggtacatgtggcaggtcaagacccagcgctccggcgccctctgggacgtcccctcccccgccgccacccagaaggccgccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgccccaagtggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcaccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagcacgccgtctcccgcggctcctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgcaagcacggcggcaacctcgtccgctgccccctctcccgcaactccacccacgagatgtactgggtctccggcgcctccggcaacatcgtctcctccgtcaacaccacctccaagatgctcctcaaccgcttcaccacccgccaccgcaagccctcctacgagaaggacgtcgacctcggcgccggcacccgctccgtctccaccgagaccgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatggtcatgaccaccaccgccaactggctctgggccctcctcggcaagaagaagaacccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggagatcgacaagaaggacggcgacctcatgtacgccgacgacaccgccggctgggacacccgcatcaccgaggacgacctccagaacgaggagctcatcaccgagcagatggccccccaccacaagatcctcgccaaggccatcttcaagctcacctaccagaacaaggtcgtcaaggtcctccgccccaccccccgcggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctccgcgagtgcggcgtcgaccgcctcaagcgcatggccatctccggcgacgactgcgtcgtcaagcccctcgacgagcgcttcggcacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgatcgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgtcatgaagcgctactccgccccctccgagtccgagggcgtcctctga

SEQ ID NO: 13171 - RNA, 9867 nt, synthetic construct
  misc_feature 1..9867: note = derived and/or modified CDS sequence (opt2) from DENV-4__HQ332174__SS-prME
  source 1..9867: mol_type = other RNA
tccaccatcaccctcctctgcctcatccccaccgccatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggccctcatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccaccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctccgccacccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggtccggccgcgagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgcctccgacctcaagtactcctggaagacctggggcaaggccaagatcttcacccccgaggcccgcaactccaccttcctcatcgacggccccgacacctccgagtgccccaacgagcgccgcgcctggaactccttcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagcgcgcctccctcatcgaggtcaagacctgcctctggcccaagacccacaccctctggtccaacggcgtcctcgagtcccagatgctcatccccaagtcctacgccggccccttctcccagcacaactaccgccagggctacgccacccagaccatgggcccctggcacctcggcaagctcgagatcgacttcggcgagtgccccggcaccaccgtcaccatccaggagaactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcaccgccggccagggcgcctccgagaccttctccatgggcctcctctgcctcaccctcttcgtcgaggagtgcctccgccgccgcgtcacccgcaagcacatgatcctcgccgtcgtcatcaccctctgcgccatcatcctcggcggcctcacctggatggacctcctccgcgccctcatcatgctcggcgacaccatgtccggccgcatcggcggccagacccacctcgccatcatggccgtcttcaagatgtcccccggctacgtcctcggcgtcttcctccgcaagctcacctcccgcgagaccgccctcatggtcatcggcatggccatgaccaccaccctctccatcccccacgacctcatggagctcatcgacggcatctccctcggcctcatcctcctcaagatcgtcacccagttcgacaacacccaggtcggcaccctcgccctctccctcaccttcatccgctccaccatgtccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccatcaccatgaccctctggtacatgtggcaggtcaagacccagcgctccggcgccctctgggacgtcccctcccccgccgccacccagaaggccgccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgccccaagtggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcaccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggccaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagcacgccgtctcccgcggctcctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgcaagcacggcggcaacctcgtccgctgccccctctcccgcaactccacccacgagatgtactgggtctccggcgcctccggcaacatcgtctcctccgtcaacaccacctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcaccgtcatgaccaccaccgccaactggctctgggccctcctcggcaagaagaagaacccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggagatcgacaagaaggacggcgacctcatgtacgccgacgacaccgccggctgggacacccgcatcaccgaggacgacctccagaacgaggagctcatcaccgagcagatggccccccaccacaagatcctcgccaaggccatcttcaagctcacctaccagaacaaggtcgtcaaggtcctccgccccaccccccgcggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctccgcgagtgcggcgtcgaccgcctcaagcgcatggccatctccggcgacgactgcgtcgtcaagcccctcgacgagcgcttcggcacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgatcgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgtcatgaagcgctactccgccccctccgagtccgagggcgtcctctga

SEQ ID NO: 13172 - RNA, 9867 nt, synthetic construct
  misc_feature 1..9867: note = derived and/or modified CDS sequence (opt2) from DENV-4__KT026308__SS-prME
  source 1..9867: mol_type = other RNA
tccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcatcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcatcaagaccaccgccaaggaggtcgccctcctccgcacctactgcatcgaggcctccatctccaacatcaccaccgccacccgctgccccacccagggcgagccctacctcaaggaggagcaggaccagcagtacatctgccgccgcgacatggtcgaccgcggctggggcaacggctgcggcctcttcggcaagggcggcgtcgtcacctgcgccaagttctcctgcctcggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtccagctccccgactacggcgagctcaccctcgactgcgagccccgctccggcatcgacttcaacgagatgatcctcatgaagatgaagaccaagacctggctcgtccacaagcagtggttcctcgacctccccctcccctggaccaccggcgccgacaccctcgaggtccactggaaccacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcaccggcgccccctgcaaggtccccatcgagatccgcgacgtcaacaaggagaaggtcgtcggccgcatcatctcctccacccccttcgccgagaacaccaactccgtcaccaacatcgagctcgagccccccttcggcgactcctacatcgtcatcggcgtcggcgactccgccctcaccctccactggttccgcaagggctcctccatcggcaagatgttcgagtccacctaccgcggcgccaagcgcatggccatcctcggcgagaccgcctgggacttcggctccgtcggcggcctcctcacctccctcggcaaggccgtccaccaggtcttcggctccgtctacaccaccatgttcggcggcgtctcctggatggtccgcatcctcatcggcctcctcgtcctctggatcggcaccaactcccgcaacacctccatggccatgtcctgcatcgccgtcggcggcatcaccctcttcctcggcttcaccgtccacgccgacatgggctgcgtcgtctcctggtccggcaaggagctcaagtgcggctccggcatcttcgtcatcgacaacgtccacacctggaccgagcagtacaagttccagcccgagtcccccgcccgcctcgcctccgccatcctcaacgcccacaaggagggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctctccaagggcaagcgcgccctcgccccccccgtcaacgacctcaagtactcctggaagacctggggcaaggccaagatcttcacccccgagacccgcaactccaccttcctcgtcgacggccccgacacctccgagtgccccaacgagcgccgcgcctggaacttcctcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagaaggcctccctcatcgaggtcaagacctgcctctggcccaagacccacaccctctggtccaacggcgtcctcgagtcccagatgctcatccccaaggcctacgccggccccatctcccagcacaactaccgccagggctacgccacccagaccgccggcccctggcacctcggcaagctcgagatcgacttcggcgagtgccccggcaccaccgtcaccgtccaggaggactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctcaacgagaaggaggagaacatggtcaagtcccaggtctccgccggccacggcacctccgagaccttctccatgggcctcctctgcctcaccctcttcgtcgaggagtgcctccgccgccgcgtcacccgcaagcacatgatcctcgtcgtcgtcaccaccctctgcgccatcatcctcggcggcctcacctggatggacctcctccgcgccctcatcatgctcggcgacaccatgtccggccgcatgggcggccagatccacctcgccatcatggccgtcttcaagatgtcccccggctacgtcctcggcatcttcctccgcaagctcacctcccgcgagaccgccctcatggtcatcggcatggccatgaccaccgtcctctccatcccccacgacctcatggagttcatcgacggcatctccctcggcctcatcctcctcaagatggtcacccacttcgacaacacccaggtcggcaccctcgccctcgccctcaccttcatcaagtccaccatgcccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctccaagcgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccgtcaccatgaccctctggtacatgtggcaggtcaagacccagcgctccggcgccctctgggacgtcccctcccccgccgccgcccagaaggccaccctcaccgagggcgtctaccgcatcatgcagcgcggcctcttcggcaagacccaggtcggcgtcggcatccacaccgagggcgtcttccacaccatgtggcacgtcacccgcggctccgtcatctgccacgagtccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccgtcttcatgaccgccaccccccccggcaccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcatcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctccgcaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcccacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgccccaagtggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggcaaggcctaccagcacgccctcaacgagctccccgagtccctcgagaccctcatgctcgtcgccctcctcggcgccatgaccgccggcatcttcctcttcttcatgcagggcaagggcatgggcaagctctccatgggcctcatcgccatcgccgtcgcctccggcctcctctgggtcgccgagatccagccccagtggatcgccgcctccatcatcctcgagttcttcctcatggtcctcctcgtccccgagcccgagaagcagcgcaccccccaggacaaccagctcatctacgtcatcctcaccatcctcaccatcatcgccctcgtcgccgccaacgagatgggcctcatcgagaagaccaagaccgacttcggcttctaccaggtcaaggccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgtcggccagctcctcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccatgggcgagaccctcggcgagaagtggaagcgccagctcaactccctcgaccgcaaggagttcgaggagtacaagcgctccggcatcctcgaggtcgaccgcaccgaggcccgctccgccctcaaggacggctccaagatcaagtacgccgtctcccgcggcacctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgccgccacggcggctccctcgtccgctgccccctctcccgcaactccacccacgagatgtactgggtctccggcgtctccggcaacatcgtctcctccgtcaacaccacctccaagatgctcctcaaccgcttcaccacccgccaccgcaagcccacctacgagaaggacgccgacctcggcgccggcacccgctccgtctccaccgagaccgagaagcccgacatgaccatcatcggccgccgcctccagcgcctccaggaggagcacaaggagacctggcactacgaccacgagaacccctaccgcacctgggcctaccacggctcctacgaggccccctccaccggctccgcctcctccatggtcaacggcgtcgtcaagctcctcaccaagccctgggacgtcgtccccatggtcacccagctcgccatgaccgacaccacccccttcggccagcagcgcgtcttcaaggagaaggtcgacacccgcaccccccagcccaagcccggcacccaggtcgtcatgaccaccaccgccaactggctctggaccctcctcggccgcaagaagaacccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggacatcgacaagaaggacggcgacctcatctacgccgacgacaccgccggctgggacacccgcatcaccgaggacgacctcctcaacgaggagctcatcaccgagcagatgaccccccaccacaagatcctcgccaaggccatcttcaagctcacctaccagaacaaggtcgtcaaggtcctccgccccacccccaagggcgccgtcatggacatcatctcccgcaaggaccagcgcggctccggccaggtcggcacctacggcctcaacaccttcaccaacatggaggtccagctcatccgccagatggaggccgagggcgtcatcacccgcgacgacatgcacaaccccaagggcctcaaggagcgcgtcgagaagtggctcaaggagtgcggcgtcgaccgcctcaagcgcatggccatctccggcgacgactgcgtcgtcaagcccctcgacgagcgcttctccacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgatcgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgccatgcgccgctactccgcccacttcgagtccgagggcgtcctctga

SEQ ID NO: 13173 - RNA, 9867 nt, synthetic construct
  misc_feature 1..9867: note = derived and/or modified CDS sequence (opt2) from DENV-4__KT026309__SS-prME
  source 1..9867: mol_type = other RNA
tccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcatcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcatcaagaccaccgccaaggaggtcgccctcctccgcacctactgcatcgaggcctccatctccaacatcaccaccgccacccgctgccccacccagggcgagccctacctcaaggaggagcaggaccagcagtacatctgccgccgcgacatggtcgaccgcggctggggcaacggctgcggcctcttcggcaagggcggcgtcgtcacctgcgccaagttctcctgcctcggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtccagctccccgactacggcgagctcaccctcgactgcgagccccgctccggcatcgacttcaacgagatgatcctcatgaagatgaagaccaagacctggctcgtccacaagcagtggttcctcgacctccccctcccctggaccaccggcgccgacaccctcgaggtccactggaaccacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcaccggcgccccctgcaaggtccccatcgagatccgcgacgtcaacaaggagaaggtcgtcggccgcatcatctcctccacccccttcgccgagaacaccaactccgtcaccaacatcgagctcgagccccccttcggcgactcctacatcgtcatcggcgtcggcgactccgccctcaccctccactggttccgcaagggctcctccatcggcaagatgttcgagtccacctaccgcggcgccaagcgcatggccatcctcggcgagaccgcctgggacttcggctccgtcggcggcctcctcacctccctcggcaaggccgtccaccaggtcttcggctccgtctacaccaccatgttcggcggcgtctcctggatggtccgcatcctcatcggcctcctcgtcctctggatcggcaccaactcccgcaacacctccatggccatgtcctgcatcgccgtcggcggcatcaccctcttcctcggcttcaccgtccacgccgacatgggctgcgtcgtctcctggtccggcaaggagctcaagtgcggctccggcatcttcgtcatcgacaacgtccacacctggaccgagcagtacaagttccagcccgagtcccccgcccgcctcgcctccgccatcctcaacgcccacaaggagggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctctccaagggcaagcgcgccctcgccccccccgtcaacgacctcaagtactcctggaagacctggggcaaggccaagatcttcacccccgagacccgcaactccaccttcctcgtcgacggccccgacacctccgagtgccccaacgagcgccgcgcctggaacttcctcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagaaggcctccctcatcgaggtcaagacctgcctctggcccaagacccacaccctctggtccaacggcgtcctcgagtcccagatgctcatccccaaggcctacgccggccccatctcccagcacaactaccgccagggctacgccacccagaccgccggcccctggcacctcggcaagctcgagatcgacttcggcgagtgccccggcaccaccgtcaccgtccaggaggactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctcaacgagaaggaggagaacatggtcaagtcccaggtctccgccggccacggcacctccgagaccttctccatgggcctcctctgcctcaccctcttcgtcgaggagtgcctccgccgccgcgtcacccgcaagcacatgatcctcgtcgtcgtcaccaccctctgcgccatcatcctcggcggcctcacctggatggacctcctccgcgccctcatcatgctcggcgacaccatgtccggccgcatgggcggccagatccacctcgccatcatggccgtcttcaagatgtcccccggctacgtcctcggcatcttcctccgcaagctcacctcccgcgagaccgccctcatggtcatcggcatggccatgaccaccgtcctctccatcccccacgacctcatggagttcatcgacggcatctccctcggcctcatcctcctcaagatggtcacccacttcgacaacacccaggtcggcaccctcgccctcgccctcaccttcatcaagtccaccatgcccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctccaagcgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccgtcaccatgaccctctggtacatgtggcaggtcaagacccagcgctccggcgccctctgggacgtcccctcccccgccgccgcccagaaggccaccctcaccgagggcgtctaccgcatcatgcagcgcggcctcttcggcaagacccaggtcggcgtcggcatccacaccgagggcgtcttccacaccatgtggcacgtcacccgcggctccgtcatctgccacgagtccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccgtcttcatgaccgccaccccccccggcaccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcatcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctccgcaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcccacaaggtcgcctccgccggcatctcctacaaggaccgcgagtggtgcttcaccggcgagcgcaacaaccagatcctcgaggagaacatcgaggtcgagatctggacccgcgagggcgagaagaagaagctccgccccaagtggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggcaaggcctaccagcacgccctcaacgagctccccgagtccctcgagaccctcatgctcgtcgccctcctcggcgccatgaccgccggcatcttcctcttcttcatgcagggcaagggcatgggcaagctctccatgggcctcatcgccatcgccgtcgcctccggcctcctctgggtcgccgagatccagccccagtggatcgccgcctccatcatcctcgagttcttcctcatggtcctcctcgtccccgagcccgagaagcagcgcaccccccaggacaaccagctcatctacgtcatcctcaccatcctcaccatcatcgccctcgtcgccgccaacgagatgggcctcatcgagaagaccaagaccgacttcggcttctaccaggtcaaggccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgtcggccagctcctcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccatgggcgagaccctcggcgagaagtggaagcgccagctcaactccctcgaccgcaaggagttcgaggagtacaagcgctccggcatcctcgaggtcgaccgcaccgaggcccgctccgccctcaaggacggctccaagatcaagtacgccgtctcccgcggcacctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgccgccacggcggctccctcgtccgctgccccctctcccgcaactccacccacgagatgtactgggtctccggcgtctccggcaacatcgtctcctccgtcaacaccacctccaagatgctcctcaaccgcttcaccacccgccaccgcaagcccacctacgagaaggacgccgacctcggcgccggcacccgctccgtctccaccgagaccgagaagcccgacatgaccatcatcggccgccgcctccagcgcctccaggaggagcacaaggagacctggcactacgaccacgagaacccctaccgcacctgggcctaccacggctcctacgaggccccctccaccggctccgcctcctccatggtcaacggcgtcgtcaagctcctcaccaagccctgggacgtcgtccccatggtcacccagctcgccatgaccgacaccacccccttcggccagcagcgcgtcttcaaggagaaggtcgacacccgcaccccccagcccaagcccggcacccaggtcgtcatgaccaccaccgccaactggctctggaccctcctcggccgcaagaagaacccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggacatcgacaagaaggacggcgacctcatctacgccgacgacaccgccggctgggacacccgcatcaccgaggacgacctcctcaacgaggagctcatcaccgagcagatgaccccccaccacaagatcctcgccaaggccatcttcaagctcacctaccagaacaaggtcgtcaaggtcctccgccccacccccaagggcgccgtcatggacatcatctcccgcaaggaccagcgcggctccggccaggtcggcacctacggcctcaacaccttcaccaacatggaggtccagctcatccgccagatggaggccgagggcgtcatcacccgcgacgacatgcacaaccccaagggcctcaaggagcgcgtcgagaagtggctcaaggagtgcggcgtcgaccgcctcaagcgcatggccatctccggcgacgactgcgtcgtcaagcccctcgacgagcgcttctccacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgatcgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgccatgcgccgctactccgcccacttcgagtccgagggcgtcctctga

SEQ ID NO: 13174 - RNA, 9867 nt, synthetic construct
  misc_feature 1..9867: note = derived and/or modified CDS sequence (opt2) from DENV-4__KF907503__SS-prME
  source 1..9867: mol_type = other RNA
tccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggcctccatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccatgatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccgccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcatcatctcctccacccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggccgacatgggctgcgtcgtctcctggtccggcaaggagctcaagtgcggctccggcatcttcgtcgtcgacaacgtccacacctggaccgagcagtacaagttccagcccgagtcccccgcccgcctcgcctccgccatcctcaacgcccacaaggacggcgtctgcggcatccgctccaccacccgcctcgagaacgtcatgtggaagcagatcaccaacgagctcaactacgtcctctgggagggcggccacgacctcaccgtcgtcgccggcgacgtcaagggcgtcctcaccaagggcaagcgcgccctcaccccccccgtctccgacctcaagtactcctggaagacctggggcaaggccaagatcttcacccccgaggcccgcaactccaccttcctcatcgacggccccgacacctccgagtgccccaacgagcgccgcgcctggaactccctcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagaaggcctccctcatcgaggtcaagacctgcctctggcccaagacccacaccctctggtccaacggcgtcctcgagtcccagatgctcatccccaagtcctacgccggccccttctcccagcacaactaccgccagggctacgccacccagaccgtcggcccctggcacctcggcaagctcgagatcgacttcggcgagtgccccggcaccaccgtcaccatccaggaggactgcgaccaccgcggcccctccctccgcacctccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtcaccgccggccagggcacctccgagaccttctccatgggcctcctctgcctcaccctcttcgtcgaggagtgcctccgccgccgcgtcacccgcaagcacatgatcctcgtcgtcgtcatcaccctctgcgccatcatcctcggcggcctcacctggatggacctcctccgcgccctcatcatgctcggcgacaccatgtccggccgcatcggcggccagatccacctcgccatcatggccgtcttcaagatgtcccccggctacgtcctcggcgtcttcctccgcaagctcacctcccgcgagaccgccctcatggtcatcggcatggccatgaccaccgtcctctccatcccccacgacctcatggagctcatcgacggcatctccctcggcctcatcctcctcaagatcgtcacccagttcgacaacacccaggtcggcaccctcgccctctccctcaccttcatccgctccaccatgcccctcatcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctcccgccgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacgtcgaggagaccaacatgatcaccctcctcgtcaagctcgccctcatcaccgtctccggcctctaccccctcgccatccccgtcaccatgaccctctggtacatgtggcaggtcaagacccagcgctccggcgccctctgggacgtcccctcccccgccgccacccagaaggccgccctctccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcatcggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccacctccaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatcctcaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagacccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgcccccgctggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggccgcgcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcatcatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcaccgcctccctcgtcatgctctccgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccttctgcgaggtcctcaccctcgccaccggccccatcctcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagcacgccgtctcccgcggctcctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgcaagcacggcggcaacctcgtccgctgccccctctcccgcaactccacccacgagatgtactgggtctccggcgcctccggcaacatcgtctcctccgtcaacaccacctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatggtcatgaccaccaccgccaactggctctgggccctcctcggcaagaagaagaacccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggagatcgacaagaaggacggcgacctcatgtacgccgacgacaccgccggctgggacacccgcatcaccgaggacgacctccagaacgaggagctcatcaccgagcagatggccccccaccacaagatcctcgccaaggccatcttcaagctcacctaccagaacaaggtcgtcaaggtcctccgccccaccccccgcggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcagaaccccaagggcctcaaggagcgcgtcgagaagtggctcaaggagtgcggcgtcgaccgcctcaagcgcatggccatctccggcgacgactgcgtcgtcaagcccctcgacgagcgcttcggcacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgaccgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgtcatgaagcgctactccgccccctccgagtccgagggcgtcctctga

SEQ ID NO: 13175 - RNA, 9867 nt, synthetic construct
  misc_feature 1..9867: note = derived and/or modified CDS sequence (opt2) from DENV-4__AY947539__SS-prME
  source 1..9867: mol_type = other RNA
tccaccatgaccctcctctgcctcatccccaccgccatggccttccacctctccacccgcgacggcgagcccctcatgatcgtcgcccgccacgagcgcggccgccccctcctcttcaagaccaccgagggcatcaacaagtgcaccctcatcgccatggacctcggcgagatgtgcgaggacaccgtcacctacgagtgccccctcctcgtcaacaccgagcccgaggacatcgactgctggtgcaacctcacctccgcctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcatcaagaccaccgccaaggaggtcgccctcctccgcacctactgcatcgaggcctccatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacatccccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctgggccgccggcgccgacacctccgaggtccactggaactacaaggagcgcatggtcaccttcaaggtcccccacgccaagcgccaggacgtcaccgtcctcggctcccaggagggcgccatgcactccgccctcaccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcatcatctcctccacccccttcgccgagtacaccaactccgtcaccaacatcgagctcgagccccccttcggcgactcctacatcgtcatcggcgtcggcgactccgccctcaccctccactggttccgcaagggctcctccatcggcaagatgctcgagtccacctaccgcggcgccaagcgcatggccatcctcggcgagaccgcctgggacttcggctccgtcggcggcctcctcacctccctcggcaaggccgtccaccaggtcttcggctccgtctacaccaccatgttcggcggcgtctcctggatggtccgcatcctcatcggcttcctcgtcctctggatcggcaccaactcccgcaacacctccatggccatgacctgcatcgccgtcggcggcatcaccctcttcctcggcttcaccgtccacgccgacaccggctgcgccgtctcctggtccggcaaggagctcaagtgcggctccggcatcttcgtcatcgacaacgtccacacctggaccgagcagtacaagttccagcccgagtcccccgcccgcctcgcctccgccatcctcaacgcccacgaggacggcgtctgcggcatccgctccaccacccgcctcgagaacatcatgtggaagcagatcaccaacgagctcaactacgtcctctgggagggcggccacgacctcaccgtcgtcgccggcgacgtcaagggcgtcctctccaagggcaagcgcgccctcgccccccccgtcaacgacctcaagtactcctggaagacctggggcaaggccaagatcttcacccccgaggccaagaactccaccttcctcatcgacggccccgacacctccgagtgccccaacgagcgccgcgcctggaacttcctcgaggtcgaggactacggcttcggcatgttcaccaccaacatctggatgaagttccgcgagggctcctccgaggtctgcgaccaccgcctcatgtccgccgccatcaaggaccagaaggccgtccacgccgacatgggctactggatcgagtcctccaagaaccagacctggcagatcgagaaggcctccctcatcgaggtcaagacctgcctctggcccaagacccacaccctctggtccaacggcgtcctcgagtcccagatgctcatccccaaggcctacgccggccccttctcccagcacaactaccgccagggctacgccacccagaccgtcggcccctggcacctcggcaagctcgagatcgacttcggcgagtgccccggcaccaccgtcaccatccaggaggactgcgaccaccgcggcccctccctccgcaccaccaccgcctccggcaagctcgtcacccagtggtgctgccgctcctgcaccatgccccccctccgcttcctcggcgaggacggctgctggtacggcatggagatccgccccctctccgagaaggaggagaacatggtcaagtcccaggtctccgccggccagggcacctccgagaccttctccatgggcctcctctgcctcaccctcttcgtcgaggagtgcctccgccgccgcgtcacccgcaagcacatgatcctcgtcgtcgtcaccaccctctgcgccatcatcctcggcggcctcacctggatggacctcctccgcgccctcatcatgctcggcgacaccatgtccggccgcatgggcggccagatccacctcgccatcatggccgtcttcaagatgtcccccggctacgtcctcggcatcttcctccgcaagctcacctcccgcgagaccgccctcatggtcatcggcatggccatgaccaccgtcctctccatcccccacgacctcatggagttcatcgacggcatctccctcggcctcatcctcctcaagatggtcacccacttcgacaacacccaggtcggcaccctcgccctctccctcaccttcatccgctccaccatgcccctcgtcatggcctggcgcaccatcatggccgtcctcttcgtcgtcaccctcatccccctctgccgcacctcctgcctccagaagcagtcccactgggtcgagatcaccgccctcatcctcggcgcccaggccctccccgtctacctcatgaccctcatgaagggcgcctccaagcgctcctggcccctcaacgagggcatcatggccgtcggcctcgtctccctcctcggctccgccctcctcaagaacgacgtccccctcgccggccccatggtcgccggcggcctcctcctcgccgcctacgtcatgtccggctcctccgccgacctctccctcgagaaggccgccaacgtccagtgggacgagatggccgacatcaccggctcctcccccatcatcgaggtcaagcaggacgaggacggctccttctccatccgcgacatcgaggagaccaacatgatcaccctcctcgtcaagctcgccctcatcaccgtctccggcctctaccccctcgccatccccgtcaccatgaccctctggtacatgtggcaggtcaagacccagcgctccggcgccctctgggacgtcccctcccccgccgccgcccagaaggccaccctcaccgagggcgtctaccgcatcatgcagcgcggcctcttcggcaagacccaggtcggcgtcggcatccacatggagggcgtcttccacaccatgtggcacgtcacccgcggctccgtcatctgccacgagaccggccgcctcgagccctcctgggccgacgtccgcaacgacatgatctcctacggcggcggctggcgcctcggcgacaagtgggacaaggaggaggacgtccaggtcctcgccatcgagcccggcaagaaccccaagcacgtccagaccaagcccggcctcttcaagaccctcaccggcgagatcggcgccgtcaccctcgacttcaagcccggcacctccggctcccccatcatcaaccgcaagggcaaggtcatcggcctctacggcaacggcgtcgtcaccaagtccggcgactacgtctccgccatcacccaggccgagcgcaccggcgagcccgactacgaggtcgacgaggacatcttccgcaagaagcgcctcaccatcatggacctccaccccggcgccggcaagaccaagcgcatcctcccctccatcgtccgcgaggccctcaagcgccgcctccgcaccctcatcctcgcccccacccgcgtcgtcgccgccgagatggaggaggccctccgcggcctccccatccgctaccagacccccgccgtcaagtccgagcacaccggccgcgagatcgtcgacctcatgtgccacgccaccttcaccacccgcctcctctcctccacccgcgtccccaactacaacctcatcgtcatggacgaggcccacttcaccgacccctcctccgtcgccgcccgcggctacatctccacccgcgtcgagatgggcgaggccgccgccatcttcatgaccgccaccccccccggcgccaccgaccccttcccccagtccaactcccccatcgaggacatcgagcgcgagatccccgagcgctcctggaacaccggcttcgactggatcaccgactaccagggcaagaccgtctggttcgtcccctccatcaaggccggcaacgacatcgccaactgcctccgcaagtccggcaagaaggtcatccagctctcccgcaagaccttcgacaccgagtaccccaagaccaagctcaccgactgggacttcgtcgtcaccaccgacatctccgagatgggcgccaacttccgcgccggccgcgtcatcgacccccgccgctgcctcaagcccgtcatctccaccgacggccccgagcgcgtcatcctcgccggccccatccccgtcacccccgcctccgccgcccagcgccgcggccgcatcggccgcaaccccgcccaggaggacgaccagtacgtcttctccggcgaccccctcaagaacgacgaggaccacgcccactggaccgaggccaagatgctcctcgacaacatctacacccccgagggcatcatccccaccctcttcggccccgagcgcgagaagaaccaggccatcgacggcgagttccgcctccgcggcgagcagcgcaagaccttcgtcgagctcatgcgccgcggcgacctccccgtctggctctcctacaaggtcgcctccgccggcatctcctacaaggaccgcgagtggtgcttcaccggcgagcgcaacaaccagatcctcgaggagaacatggaggtcgagatctggacccgcgagggcgagaagaagaagctccgccccaagtggctcgacgcccgcgtctacgccgaccccatggccctcaaggacttcaaggagttcgcctccggccgcaagtccatcaccctcgacatcctcaccgagatcgcctccctccccacctacctctcctcccgcgccaagctcgccctcgacaacatcgtcatgctccacaccaccgagcgcggcggcaaggcctaccagcacgccctcaacgagctccccgagtccctcgagaccctcatgctcgtcgccctcctcggcgccatgaccgccggcatcttcctcttcttcatgcagggcaagggcatcggcaagctctccatgggcctcatcgccatcgccgtcgcctccggcctcctctgggtcgccgagatccagccccagtggatcgccgcctccatcatcctcgagttcttcctcatggtcctcctcatccccgagcccgagaagcagcgcaccccccaggacaaccagctcatctacgtcatcctcaccatcctcaccatcatcggcctcatcgccgccaacgagatgggcctcatcgagaagaccaagaccgacttcggcttctaccaggtcaagaccgagaccaccatcctcgacgtcgacctccgccccgcctccgcctggaccctctacgccgtcgccaccaccatcctcacccccatgctccgccacaccatcgagaacacctccgccaacctctccctcgccgccatcgccaaccaggccgccgtcctcatgggcctcggcaagggctggcccctccaccgcatggacctcggcgtccccctcctcgccatgggctgctactcccaggtcaaccccaccaccctcatcgcctccctcgtcatgctcctcgtccactacgccatcatcggccccggcctccaggccaaggccacccgcgaggcccagaagcgcaccgccgccggcatcatgaagaaccccaccgtcgacggcatcaccgtcatcgacctcgagcccatctcctacgaccccaagttcgagaagcagctcggccaggtcatgctcctcgtcctctgcgccggccagctcctcctcatgcgcaccacctgggccttctgcgaggtcctcaccctcgccaccggccccgtcctcaccctctgggagggcaaccccggccgcttctggaacaccaccatcgccgtctccaccgccaacatcttccgcggctcctacctcgccggcgccggcctcgccttctccctcatcaagaacgcccagaccccccgccgcggcaccggcaccaccggcgagaccctcggcgagaagtggaagcgccagctcaactccctcgaccgcaaggagttcgaggagtacaagcgctccggcatcctcgaggtcgaccgcaccgaggccaagtccgccctcaaggacggctccaagatcaagcacgccgtctcccgcggctcctccaagatccgctggatcgtcgagcgcggcatggtcaagcccaagggcaaggtcgtcgacctcggctgcggccgcggcggctggtcctactacatggccaccctcaagaacgtcaccgaggtcaagggctacaccaagggcggccccggccacgaggagcccatccccatggccacctacggctggaacctcgtcaagctccactccggcgtcgacgtcttctacaagcccaccgagcaggtcgacaccctcctctgcgacatcggcgagtcctcctccaaccccaccatcgaggagggccgcaccctccgcgtcctcaagatggtcgagccctggctctcctccaagcccgagttctgcatcaaggtcctcaacccctacatgcccaccgtcatcgaggagctcgagaagctccagcgcaagcacggcggctccctcgtccgctgccccctctcccgcaactccacccacgagatgtactgggtctccggcgtctccggcaacatcgtctcctccgtcaacaccacctccaagatgctcctcaaccgcttcaccacccgccaccgcaagcccacctacgagaaggacgtcgacctcggcgccggcacccgctccgtctccaccgagaccgagaagcccgacatgaccatcatcggccgccgcctccagcgcctccaggaggagcacaaggagacctggcactacgaccaggagaacccctaccgcacctgggcctaccacggctcctacgaggccccctccaccggctccgcctcctccatggtcaacggcgtcgtcaagctcctcaccaagccctgggacgtcatccccatggtcacccagctcgccatgaccgacaccacccccttcggccagcagcgcgtcttcaaggagaaggtcgacacccgcaccccccagcccaagcccggcacccgcatggtcatgaccaccaccgccaactggctctgggccctcctcggcaagaagaagaacccccgcctctgcacccgcgaggagttcatctccaaggtccgctccaacgccgccatcggcgccgtcttccaggaggagcagggctggacctccgcctccgaggccgtcaacgactcccgcttctgggagctcgtcgacaaggagcgcgccctccaccaggagggcaagtgcgagtcctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttcggccgcgagaactcctggtccggcgtcgagggcgagggcctccaccgcctcggctacatcctcgaggacatcgacaagaaggacggcgacctcatctacgccgacgacaccgccggctgggacacccgcatcaccgaggacgacctcctcaacgaggagctcatcaccgagcagatggccccccaccacaagatcctcgccaaggccatcttcaagctcacctaccagaacaaggtcgtcaaggtcctccgccccacccccaagggcgccgtcatggacatcatctcccgcaaggaccagcgcggctccggccaggtcggcacctacggcctcaacaccttcaccaacatggaggtccagctcatccgccagatggaggccgagggcgtcatcacccaggacgacatgcacaaccccaagggcctcaaggagcgcgtcgagaagtggctcaaggagtgcggcgtcgaccgcctcaagcgcatggccatctccggcgacgactgcgtcgtcaagcccctcgacgagcgcttctccacctccctcctcttcctcaacgacatgggcaaggtccgcaaggacatcccccagtgggagccctccaagggctggaagaactggcaggaggtccccttctgctcccaccacttccacaagatcttcatgaaggacggccgctccctcgtcgtcccctgccgcaaccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccatggccatctgctccgccgtccccaccgagtggttccccacctcccgcaccacctggtccatccacgcccaccaccagtggatgaccaccgaggacatgctcaaggtctggaaccgcgtctggatcgaggacaaccccaacatgaccgacaagacccccgtccactcctgggaggacatcccctacctcggcaagcgcgaggacctctggtgcggctccctcatcggcctctcctcccgcgccacctgggccaagaacatccacaccgccatcacccaggtccgcaacctcatcggcaaggaggagtacgtcgactacatgcccgtcatgaagcgctactccgcccccttcgagtccgagggcgtcctctga

SEQ ID NO: 13176 - RNA, 9879 nt, synthetic construct
  misc_feature 1..9879: note = derived and/or modified CDS sequence (opt3) from DENV-1__AB608789__SS-prME
  source 1..9879: mol_type = other RNA
agcgtgaccatgctgctcatgcttatgcccaccgcactggctttccacttgactacgaggggcggggagcctcatatgatcgtcaccaagcaggaaaggggaaaatccttactgtttaagacatctgccggtgttaatatgtgcactctaattgccatggacctcggcgagctgtgtgaagataccatgacatacaaatgcccacggataaccgaggcggaaccggacgatatcgactgttggtgcaatgctactgatacatgggtgacctatgggacgtgttcacaaactggagagcaccgccgagacaagcgtagtgtggcccttgcaccccatgtgggcctgggtttggagaccagaacagaaacttggatgagctccgagggggcctggaaacagattcagagggtcgaaacctgggctctccggcaccctggattcacagtgatcgcactgtttctggcccatgctattggcacctctatcacgcagaagggcataatcttcattctcttaatgctggttactccatcgatggccatgcgctgcgtggggatcggatcaagagattttgtcgagggtcttagcggcgcgacatgggtggacgtagttttggagcacgggagttgtgtgaccactatggcaaaggataaacccacactggacattgaactactcaagaccgaggtcacgaaccctgccgtgctgaggaaactttgcatcgaagctaagatatccaataccacaactgattctcggtgtccaacccaaggagaggccacactggtggaggaacaggacgcaaacttcgtctgccgccgaacttttgttgatagaggctggggtaatgggtgtggattgttcggcaaaggcagcctcattacctgcgctaagtttaagtgcgtgacaaaactggaggggaagatcgtacagtacgaaaacttaaaatattccgtgattgtcaccgtgcacactggagaccagcatcaagttggtaatgagtcaacggaacacggcacaaccgccactatcacaccccaggcgcctacaagtgagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaattcagacctctggaacaactaccatatttgccggccatttaaaatgccgtctgaagatggataaactaacactcaaggggatgtcctatgtcatgtgtactggatcgttcaaactggagaaggaagtggctgagacccagcacggtacggtccttgtgcagatcaagtacgagggcacagacgcgccttgcaaaattccattctcgacccaagatgaaaagggggttactcagaacggacgcttgatcacagcaaatcccatagtgaccgacaaagagaagcctgtaaacattgaagccgagccaccctttggcgagtcttatatcgtcatcggtgctggggaaaaagccctgaagctctcctggttcaagagaggctcaagtattggaaaaatgtttgaggcaactgccaggggcgctcggcgaatggccatcctgggggataccgcatgggacttcggaagcattggtggcgtgtttacatccgttgggaaacttgtgcatcagatattcggaacggcgtacggcgtcctgttttctggtgtgagctggaccatgaaaatcgggattggcgtattgctcacttggctgggattaaattcacgcagtacatccctgagcatgacctgtatcgctgtgggcctagttacactctacctgggggtcatggtgcaggccgattctggatgcgtgatcaactggaagggcagagaacttaaatgtggttcagggattttcgtcactaatgaggttcacacctggacggaacaatataagtttcaggcagacagtccgaagaggttgagcgccgctataggaaaagcctgggaggagggcgtgtgcggtatccggtccgcaacacgcctggaaaacattatgtggaagcagatctctaacgagctcaatcatattctgttagaaaacgacatgaaattcaccgtggtagtcggcgatgtggttgggatcctggctcagggaaagaaaatgataagacctcaacccatggagtacaagtattcgtggaaaagctggggcaaggccaagatcattggggcggacgtgcagaatactacctttatcattgatggaccaaacacacctgaatgtcccgacgatcagagggcctggaatatctgggaggtcgaggactacggcttcggtatatttactaccaacatttggcttaaattgcgtgattcctatacacaggtgtgcgaccaccggctcatgtcagctgcaatcaaggatagtaaagccgttcacgctgacatggggtactggattgaatctgagaagaatgaaacgtggaaactggcccgagcatccttcatcgaggtgaagacctgtatatggccaaagtcccatactctatggtcaaacggagtactggaaagcgagatgatcattcccaaaatctatggcggtcctatttctcaacacaattacagaccaggctacttcacacagaccgcggggccgtggcatctcggaaagctggagcttgattttgacttgtgcgaaggcactacagtcgtggtggatgagcactgcgggaacaggggaccctccctgcgcaccacgactgtcaccggcaaaatcatacacgaatggtgttgccggagttgtacattacctccactcagattcaagggtgaggacgggtgctggtatggaatggagattaggcccgttaaagaaaaggaggaaaatctggtaaagagcatggtatctgccggctccggtgaggtggactcatttagtcttggcctgttgtgtatgagcatcatgatcgaagaggtcatgcgctcgcgatggtcccggaaaatgctcatgaccgggactctggctgtgttcctactgctcattatgggacagctgacatggaacgatcttatccgtttgtgcattatggttggcgccaatgcatctgacagaatggggatgggaaccacatacctggctttaatggccacttttaagatgaggcctatgttcgcagtgggcctcctgtttcgccggcttaccagcagagaggtcctgctactcacgataggtctgtcattggtggccagtgttgaactgccaaactccttagaggaactcggggatggactggctatgggcatcatgattcttaaactgttgacagacttccaatctcatcagctctgggcgaccctgctaagcctgacttttatcaagaccacagtgtcccttcactatgcctggaaaactatggcaatggtcctctcaattgtaagcctgttccccttgtgtctgagtaccacgtctcagaagacaacctggttaccggtgctcctgggctcccttgggtgcaagcctctgactatgtttttgatcgctgagaataaaatatggggaagaaagagctggccactcaacgaaggtatcatggccgttggcattgtgtcgatcctgctatcatctctgcttaaaaacgatgtccccctcgccgggcctctgattgctggaggcatgttgatcgcatgttacgtgataagtggttccagcgccgacttatctctggagaaggcggctgaggtaagctgggaagaggaagccgagcattccggggcatcacacaatattctcgtggaagtccaggatgacggaacaatgaaaatcaaggatgaggagcgagacgataccctgactatccttctgaaagccacattgctagctgttagtggcgtgtatcccctgagcattccagcaaccctcttcgtgtggtacttttggcaaaagaagaaacagcgctctggcgtcctgtgggacacgccttcacccccagaagtggagcgggccgttcttgatgaagggatatatagaatcatgcagaggggattactgggtcgtagccaggtaggcgtgggggtcttccaagagaacgtgttccatactatgtggcacgttacccgcggagcggtgctcatgtaccagggcaagcggttggagccgagttgggctagcgtcaaaaaggacctgatttcctacggtgggggatggagactccagggctcttggaatacaggcgaagaggtgcaggtaatcgccgtcgaacctgggaaaaaccccaagaatgtgcaaaccgcaccaggaacatttaagactcccgagggtgaagttggcgccattgctctggacttcaaacctgggacctcgggaagcccaatcgtgaacagggagggcaagatagtcggtctttatgggaatggagtggttacgacatcaggcacttacgtgtccgccatcgcacaggctaaagccagtcaggagggccccctgcctgaaattgaggatgaagtctttcgaaagcggaacttgaccatcatggacctacacccggggtctggaaaaacacgcagatatctgccagcgattgtgagggaggccatcaagcggaagctccgaaccttaatactggcacccactagagtagtggctagcgaaatggccgaggctcttaaaggtatgcctattcgctaccaaaccacagcagttaagtccgagcatacgggcaaagaaatcgtcgatctgatgtgccacgccactttcaccatgaggctcttgtcaccagtgcgtgtgcccaattataacatgatcattatggacgaggcccattttacagatccttctagcatcgctgcgcgggggtacataagtaccagagtcggaatgggcgaagcagccgctattttcatgactgccacaccgcccggttccgtagaggcatttccacagagcaatgccgtgatccaggacgaagagagggatattcctgagcgctcttggaactcagggtatgaatggatcaccgacttccccggaaagacggtttggtttgtgccatccataaaaagtggcaatgatattgctaactgtctgcgaaagaatggcaagagagtcatccagctcagccggaaaactttcgacacagagtaccaaaagaccaaaaacaacgattgggactacgtggttaccactgacatctcggaaatgggggcgaattttagggccgatcgcgtgattgaccctcgtagatgcctgaagcccgtcatccttaaagatggaccagagcgggtgattctagcaggtccgatgcctgtaacagtggcttctgccgcacagaggcgcggccgaatagggagaaaccacaataaggagggagaccagtatatctacatgggccagcccctgaacaatgatgaagaccatgcccactggaccgaggctaagatgttgttagataacattaatacaccagaaggtatcatccccgccctgttcgagcctgaacgggagaaatccgcggcaattgacggggagtataggctccgcggcgaagccagaaagactttcgttgagctgatgaggcggggagatcttccagtctggctgagctacaaagtggcttcagaaggctttcaatatagtgaccgtcgctggtgcttcgatggggagcgaaacaatcaggtgctcgaagagaacatggacgtcgagatatggacgaaggaaggagagaggaagaagttgaggccccggtggctggatgcccgcacctactctgaccctctagctctgagagaatttaaagagttcgcagccggtaggcggtccgttagcggcgacctcatccttgaaattgggaagctgccgcagcacttaacacagcgagctcaaaatgccttggataacctggtgatgctccataattcagagcagggaggcagagcatatcgccacgcgatggaggaactgccagacactatcgagacccttatgctgctcgccttgattgctgtactgacaggtggggtgaccttatttttcctaagtggcaggggactgggcaagactagcatcgggctcctttgtgtcatggcctcctctgtgctgttgtggatggcaagcgttgaaccccattggatagctgcctccatcattctggagtttttcctcatggtgctgcttatccctgagcccgatcggcagcgtacgccacaggacaaccaactcgcatacgtcgtaattggactgttgtttatgatcctgaccgtggccgctaatgaaatgggtttactagagacaactaaaaaggatctgggcatagggcacgttgcggtggaaaaccaccatcacgccaccatgctcgacgtcgatcttcatcctgcatcagcttggacactgtacgccgtggccaccactattatcacacccatgatgagacacacgattgagaacaccactgcaaatatctctttgacagctatagccaaccaggcggctatcctgatgggactcgacaaaggctggccaattagtaagatggatatcggtgtccctctgcttgccttagggtgctatagccaggtgaatccgctgaccctcaccgcagccgttttgatgctggtggctcattacgcaattatcggccccggactacaagccaaagcgacaagggaagctcagaagcgcactgccgcaggcataatgaagaacccaacggtagacgggattgtggccatcgatctggaccctgtcgtttatgatgctaaattcgagaagcagctcggacagatcatgcttctgattttgtgtaccagccaaatcctgctcatgcggacaacttgggccctgtgcgagtccataaccttagcaacaggcccccttaccactctgtgggaaggttctccagggaaattttggaatacgacaattgctgtgtcaatggccaacatcttccgaggaagctacctcgcgggcgccggtctagcattttccctgatgaagagtttgggcgggggaagaaggggcaccggggctcagggagagactctgggcgaaaaatggaagcgccagctcaatcagctttctaagagcgagttcaacacctataaacggtcaggtattatggaagtcgacagatccgaggccaaggagggggtgaaacgtggagaaacaactaagcacgcagtaagtaggggcaccgctaaactgcggtggttcgtggagcgcaatttggttaagcctgaaggtaaggtgatcgacctgggctgtgggcgaggaggctggagctactattgcgccgggctcaaaaaggtcacagaggtgaaaggatacacgaagggcggtcccgggcacgaggaaccgataccaatggccacctacggatggaacttagtcaaactgcattctggcaaggatgtgtttttcactcctcccgagaaatgtgacacacttctgtgcgatatcggcgaatcctcaccaaatcccaccattgaggaagggagaactctaagggttctcaagatggtagagccttggctgcggggaaaccaattttgtatcaagattttgaatccgtatatgcccagcgtggtcgagacactggaacagatgcagcgcaaacacggtggcatgctcgtgagaaacccactttcgagaaattctacccatgagatgtactgggttagttgcgggacgggaaacatcgtgtccgcggtcaatatgaccagccgaatgctgttaaaccggttcacaatggctcaccgtaagcctacttatgaaagagacgtggatctgggcgcaggtacccgccacgtagccgtggagcccgaagttgctaacttggacattatcgggcagaggatagagaatattaaacatgagcacaagtcaacatggcattacgatgaagacaacccttataaaacttgggcctaccacggatcctatgaggtcaagccatctggcagcgcaagttccatggtgaatggcgtggtcaagctcctgaccaaaccctgggatgttatccctatggtgacacaaatcgccatgaccgacactacgccatttgggcagcagcgggtattcaaggaaaaagtggatacaagaacccccaaggctaaacgcggaactgcgcaaattatggaggtcaccgccaggtggctatggggttttcttagccgaaacaagaagccgcggatatgtacaagagaagagttcacgaggaaagtgcgctctaatgcagctatcggcgccgtttttgtggacgagaaccagtggaactcagcaaaggaagccgtcgaggacgaacgtttctgggatctggtgcatcgggagagagaactccacaaacaggggaagtgcgctacctgcgtatacaacatgatgggaaaaagggagaagaagctgggcgagtttggtaaagcccctgaaagtcgcgcgatttggtacatgtggttgggggcacgattcctggagtttgaagccctcggattcatgaatgaggaccactggttctcccgggagaacagcctttctggcgttgaaggcgaggggctgcataagttaggatatatcctgagagatatttcgaaaatcccaggtggcaatatgtacgctgacgatactgccgggtgggacacaaggataaccgaagatgacttgcagaacgaggcaaagatcactgatattatggaacccgagcacgctctcctggccacatcaatctttaaactaacctatcaaaataaggtggtccgcgtgcagagacctgctaaaaacggaacagtgatggacgtcattagccggagggatcagcgtggctccggtcaggttgggacttacggacttaataccttcacgaacatggaggcccaactgatccgacagatggaaagtgagggcatattttctagctccgaactcgagaccccaaacctggcagaacgcgtgttggactggttaggcaagtatggggtagagagactgaagcggatggcgatttcaggagatgactgtgtggtcaaacccatcgacgataggttcgccacagctctcactgcccttaatgacgtgggtaaggttcgcaaagatatcccgcagtgggagcctagtaagggctggaacgactggcagcaagtgcccttttgctctcatcacttccaccagctgattatgaaagatgggagagaaatagtcgtgccatgtcggaatcaggacgagctagtaggaagggcacgagttagccagggcgctggttggtccctgcgtgaaaccgcctgcctcgggaagtcatacgcacaaatgtggcagttgatgtattttcatagacgcgatctgcggcttgccgcgaacgctatctgtagcgccgtgcctgtcgactgggtgcccacatctaggactacctggtccattcacgcacatcaccagtggatgacgacagaggatatgctgagtgtttggaatagagtgtggatcgaagagaacccatggatggaggacaagacccatgtcagctcgtggggagatgtgccctacctcggcaaacgcgaagaccaatggtgcggctccttaattgggctgactgcccgggctacatgggccaccaatatccaggtagcaataaaccaggtgaggcgattgatcggaaatgagaactacctggactatatgacttctatgaagagattcaaaaatgaatcagatcctgagggtgctctctggtga

SEQ ID NO: 13177 - RNA, 9879 nt, synthetic construct
  misc_feature 1..9879: note = derived and/or modified CDS sequence (opt3) from DENV-1__AB608788__SS-prME
  source 1..9879: mol_type = other RNA
agcgtgaccatgctgctcatgcttctgcccaccgtcttggccttccacttaactacgagaggaggggagcctcatatgatcgttaccaagcaggaaaggggaaaatccctgctatttaagacatctgctggtgtgaatatgtgcactctcattgccatggacctgggcgagctttgtgaagataccatgacatacaaatgcccacggataaccgaggccgaaccggacgatgtagactgttggtgcaatgcgactgatacatgggtgacctatgggacgtgttcacaaactggagagcaccgccgagacaagcgtagtgtcgctctggcaccccatgtgggcttgggtctcgagaccagaacagaaacttggatgtcctccgagggggcgtggaaacagatccagagggttgaaacctgggccctgcggcaccctggattcacagtgattgctctgtttctcgcacatgccatcggcacctctattacgcagaagggcatcatattcatcttactgatgcttgtcactccatcgatggctatgcgctgcgtggggattggaaacagagattttgtagagggtttgtcaggcgccacatgggttgacgtggtcctggagcacgggagctgtgtgaccactatggcgaaggataaacccacactagacatcgaactcctgaagaccgaggtgacgaatcctgcagtccttaggaaactgtgcattgaagccaagatcagtaacaccacaactgattcccggtgtccaacccaaggagaggctacattggttgaagaacaagacgccaatttcgtgtgccgccgaacttttgtagatagaggctggggtaacgggtgtggactcttcggcaaaggctctctgataacctgcgcaaagtttaagtgcgtgacaaaattagaggggaagattgtccagtacgaaaatctgaaatatagcgtgatcgttaccgtgcacactggagaccagcatcaagtcggtaacgagtccacggaacacggcacaaccgctactattacaccccaggcccctacatcagagatccagctcaccgactacggggcgcttactctggattgtagtccaaggacaggattggacttcaatgaaatggtgctactgacgatgaaggagaaaagctggctcgtacataagcagtggtttctggatcttccgctgccctggacctctggcgccactacatcccaagagacctggaaccggcaggacttgctcgttacattcaaaactgcacacgctaagaagcaggaagtggtcgtgctgggttcacaagagggggccatgcacaccgctttaacgggcgccaccgaaatccagacaagcggaactaccacaatttttgcaggccatctgaaatgccgtctaaagatggataaactcactctgaaggggatgagttatgtcatgtgtaccggatctttcaaacttgagaaggaagtggccgagacgcagcacggtacagttttggtgcaggtaaagtacgagggcaccgacgctccttgcaaaataccattctccactcaagatgaaaagggggtcacacagaatggacgcgtgatcaccgcgaaccccattgttactgacaaagagaagcctgtgaatatcgaagcagagccaccctttggcgagagctatatagtcgtgggtgccggggaaaaagctctgaagctctcgtggttcaagaaaggctctaccattggaaagatgtttgaggccacagcaagaggcgccaggcggatggctatcctgggggatacggcctgggacttcggatccatcggtggcgtatttacctcagtggggaaacttgttcatcagattttcggaactgcatacggcgtcctgtttagtggtgtgagctggacaatgaagatcgggattggcgtgttgctcacctggctgggattaaactcccgatctacaagcctgtcaatgacttgtatagcggtcggcctagttaccctctacctgggggtgatggtgcaggctgatagtggatatgtaatcaattggaaaggccgcgaacttaagtgcggttccgggattttcgtcacgaacgaggtgcacacatggaccgaacaatacaagtttcaggccgacagcccgaaaagattgtctgcagccatcggaaaggcttgggaggagggcgtttgtggtatcaggtcagccactcggctggaaaacattatgtggaaacagataagtaatgagctcaaccatatcctgttagaaaatgacatgaagttcaccgtggtcgtgggcgatgttagcgggattctggcacagggcaagaagatgatccgccctcaacccatggagcacaaatattcctggaagtcttggggcaaggctaaaattatcggggccgacgtgcagaactcgacatttataatcgatggaccaaatactcctgaatgccccgacgatcagagagcgtggaacatttgggaggtagaggactacggcttcggtatctttaccacaaatatttggcttaagttgagggatagctatacgcaggtctgtgaccaccgtctcatgtccgccgctatcaaagattcaaaggcagtgcatgccgacatggggtactggatagaaagtgagaaaaacgaaacctggaagctggctcgggcctctttcattgaggtgaagacttgcgtctggccaaaaagccacacactatggtccaatggagttctggaatcagagatgatcattcccaagatctatggcggtcctataagccaacataactaccgaccaggctacttcacccagacttctgggccgtggcacctcggaaaactggagcttgattttgacttgtgtgaaggcacaaccgtggtagtggatgagcactgcgggaatagaggaccctccctgaggacgactaccgtcacaggcaagatcattcatgaatggtgctgtcgcagttgcaccttacctccactccggttcaaaggtgaggacgggtgttggtatggaatggagatcagacccgtgaaggaaaaggaggaaaacctggttaaaagcatggtgtctgcaggctccggtgaggtcgactcatttagtcttggcctgttgtgcattagcatcatgatagaagaggtgatgaggtcgcgctggtcccgaaagatgctcatgactgggacactggcggttttcctactgctcattatgggacagctgacctggaatgatcttatccggttgtgtatcatggtgggcgccaacgcttctgaccgtatggggatgggaacaacttacctggccttaatggcaacctttaaaatgagacctatgttcgctgtcggcctcctgtttaggcgccttacgagccgggaggtactgctactcacaattggtctgtcattggtggccagtgttgaactgccaaattccttagaggaactcggggatggactggcaatgggcatcatgattcttaagctgttgaccgacttccaatctcaccagctctgggccgctctgctaagcctgacttttataaaaaccacattctcccttcattatgcgtggaagactatggccatggtgctctcaatcgtcagcctgtttcccttgtgcctgagtaccacgtctcagaagacaacctggttaccggtgctcctgggctcccttgggtgtaaacctctgactatgttcttgattgcagagaacaagatctggggaagaaaaagctggccactcaacgaaggtattatggctgtaggcatcgtgtcgatactgctatcatctctgcttaagaatgatgtccccctcgccgggcctctgatcgccggaggcatgttgattgcttgctacgttatcagtggttccagcgcagacttatctctggagaaagccgcggaggtgagctgggaagaggaagctgagcactccggggcctcacataacattctcgtggaagtccaggatgacggaacaatgaagatcaaagatgaggagagggacgataccctgactatacttctgaaggcaacattgctagccgtgagtggcgtttatcccctgagcattccagctaccctctttgtatggtacttctggcaaaagaaaaagcagcgatctggcgtgctgtgggacacgccttcacccccagaagtcgagcgcgcagtgcttgatgacgggatctatcggatcatgcagagaggattactgggtaggagccaggttggcgtgggggtcttccaagaaaatgtgtttcacactatgtggcacgtaacccgtggagccgtcctcatgtaccagggcaaacgcttggagccgagttgggcgagcgtgaagaaagacctgatttcctacggtgggggatggcggctccagggctcttggaacacaggcgaggaagttcaggtgatagctgtcgagcctgggaagaatcccaagaacgtgcaaaccgccccaggaacattcaaaactcccgaaggtgaggttggcgcaatcgccctggattttaagcctgggacctcgggaagcccaattgtgaatagagaaggcaaaatcgtcggtctttatgggaacggagtggtaacgacatcaggcacttacgtgtccgctattgcccaggcaaaggctagtcaggagggccccctgcctgagatcgaagacgaggttttcaggaaacgaaatttgaccataatggatctacatccggggtctggaaagacacggcgctatctgccagccatcgtcagagaagcgattaagaggaaactccggaccttaatcctggcccccactcgagtggtggcaagcgagatggctgaagcccttaagggtatgcctattagataccaaaccacagctgtcaaatccgagcacacgggcaaggagatcgtagacctgatgtgtcatgcaacttttaccatgcgcctcttgtcaccagtgagggttcccaactataatatgataattatggatgaagcccacttcacagacccttctagcatcgccgctcgtgggtacatcagtacccgggtgggaatgggcgaggcggcagccatttttatgactgctacaccgcccggttccgtcgaagccttcccacagagcaacgcagtgatccaggatgaggaaagagacatacctgagaggtcttggaactcagggtatgattggattaccgactttcccggaaaaacggtttggttcgtgccatccatcaagagtggcaacgatattgccaattgcctgcgcaagaacggcaaacgagtcatccagctcagcagaaagacttttgacacagagtaccagaaaaccaagaacaatgactgggattacgtggtaaccactgacatatcggaaatgggggctaacttccgggcggatagggtgattgaccctcgccgttgtctgaaacccgttatccttaaggatggaccagagagagtcatcctagccggtccgatgcctgtgacagtggcatctgctgcccagcggaggggccgcattgggcgaaatcagaacaaggaaggagaccagtatatctacatgggccaacccctgaataacgatgaggaccatgcacactggaccgaggccaaaatgttgttagataatattaacacaccagaaggtataatccccgctctgttcgagcctgaaagagagaagtccgccgcgattgacggggaatatcggctcaggggcgaggcacgcaaaacttttgtcgagctgatgagaaggggagatcttccagtttggctgagctacaaggtggcctcagaaggcttccagtatagtgaccggcgttggtgctttgatggggagcgcaataaccaggtactcgaagagaatatggacgtggaaatctggacgaaagagggagagcgaaagaaattgagacccaggtggctggacgctcggacctactctgatcctctagccctgcgcgagttcaaggagtttgctgcaggtagaaggtccgtcagcggcgacctcatccttgaaattgggaagctgccgcagcacttaacacaacgggcccagaacgctttggataatctggtgatgctccataactcagagcagggaggccgagcctatagacacgcaatggaagaactgccagacactatagagacccttatgctgctcgcgttgatcgccgttctgacaggtggggtgaccttattctttctaagtggccgcggactgggcaaaactagcattgggctcctttgcgtcatggcttcctctgtactgttgtggatggccagcgtggaaccccattggatcgcagcttccattatcctggagttctttctcatggttctgcttatacctgaacccgataggcagcggacgccacaagacaatcagctcgcctacgtggtcatcggactgttgttcatgattctgaccgtggcagccaacgagatgggtttactagagacaactaagaaagatctgggcatcgggcacgtcgctgtggaaaaccaccatcacgcgaccatgctcgacgttgatcttcatcctgcctcagcatggacactgtacgctgtggccaccactattatcacacccatgatgcgtcacacgatagagaataccactgccaacatttctttgacagcaatcgctaatcaggccgcgattctgatgggactcgacaagggctggccaatcagtaaaatggatataggtgtacctctgcttgctttagggtgttattcgcaagtgaacccgctgaccctcaccgccgcagtcttgatgctggttgcccattacgctatcattggccccggactacaggcaaaggccacaagagaagcgcagaagaggactgctgccggcatcatgaaaaatccaacggtggacgggattgtcgcaatcgatctggaccctgtggtatatgacgccaagtttgagaaacagctcggacaaataatgcttctgattttgtgcaccagccagatcctgctcatgcgcacaacttgggctctgtgtgaatccatcaccttagccacaggcccccttaccactctgtgggagggttctccagggaagttctggaacacgacaattgcagtgtcaatggctaatatctttcggggaagctacctcgccggcgcgggtctagccttctccctgatgaaaagtttgggcgggggacgaagaggcaccggggcacagggagagactctgggcgaaaagtggaagaggcagctcaaccaactttctaaaagcgagttcaatacctataagcgctcaggtataattgaagttgatcggtccgaggctaaagaagggctgaagagaggagagacaactaaacacgccgtgagtcgtggcaccgcaaagttgaggtggtttgtcgagcggaacctggtgaagcctgaaggtaaagtcatcgacctcggctgcgggcgcggaggctggagctactattgtgctgggttaaagaaagtgacagaggttaagggatacacgaaaggcggtgccgggcacgaggaacccattccgatggccacctacggatggaatctggtaaaactttattctggcaaagatgtgttctttactccacctgaaaagtgcgacacactgctatgtgatatcggcgagtcctcacccaacccaaccatagaggaagggcgaactctcagagtcctgaagatggtggagccctggttgaggggaaatcagttctgcatcaaaattctgaacccttacatgccgagcgttgtggaaacactcgagcagatgcagcggaagcatggtggcatgcttgtccgcaatcccctgtcgagaaactctacccacgagatgtattgggtgagttgtgggacgggaaatatcgtatccgcggtgaacatgaccagcaggatgttactgaaccgatttacaatggctcatcggaaaccaacttacgaacgtgacgttgatttgggcgcaggtaccagacacgtcgccgtggagcctgaagtggctaatctcgacattatcgggcaacgcattgagaacatcaagcacgaacataaatcaacatggcactatgatgaggacaatccctacaagacttgggcctatcatggatcctacgaggtcaagccttctggcagcgcaagttccatggttaacggcgtggtaaggctgctaaccaaaccatgggatgtgatacccatggtcacacagattgccatgaccgacactacgcctttcgggcagcaacgggtgtttaaggaaaaagttgacacaagaaccccaaaggctaaacagggaactgcacaggtgatggaggtcaccgcccgctggctttggggtttcctgagcaggaataagaagccccgaatctgcacacgggaagagtttacgagaaaagtgaggtctaacgcagctatcggcgccgtattcgttgatgaaaatcagtggaactcagcaaaggaggccgtggaggacgaacgcttttgggatctcgtccaccgtgagcgggaactgcataaacaagggaagtgtgctacctgcgtgtacaatatgatgggaaaaagagagaagaagttgggcgagttcggtaaagccaaggggagtagggcgatttggtatatgtggctgggagcacgctttctcgagttcgaggcccttggcttcatgaacgaagaccactggttttcccgagagaatagcctgtctggcgtggaaggggagggattacaccggctgggttacatattgagagatatctcgaaaattccgggcgggaacatgtatgctgacgatactgccggatgggacacaaggatcaccgaggatgacctccagaatgaagcaaagattactgatatcatggagcctgaacatgctctgctagccacatcaatattcaaacttacctaccagaacaaggtcgttcgcgtgcagagaccagctaaaaatggcacagtaatggacgtgatcagccggagggatcaacgtggttccgggcaggtcggaacttatggcctgaacacctttacgaacatggaggcccagctcattcgacagatggaaagtgagggcatcttctctcccagcgagctggaaacccctaatttggcagagcgcgtgttagactggctggaaaagtacggggttgagagactcaagcggatggcgatttccggagacgattgcgtggtcaaaccaatcgacgataggtttgccacagctcttactgccctgaacgacatgggtaaggtgcgcaaagatataccccaatgggaaccgtcaaagggctggaatgactggcagcaggtacctttctgtagtcaccattttcaccagctaattatgaaagatgggagagagatcgttgtgccctgccggaaccaagacgagctggtcggaagggcacgagtgtctcagggcgctggttggagcctccgtgaaaccgcctgtttggggaagtcctatgcacagatgtggcaactgatgtacttccacagacgcgatcttcggctggccgcgaatgctatctgctcagccgttccagtggactgggtccctacaagcaggactacctggtctattcatgcacaccatcagtggatgacgacagagaacatgctctccgtgtggaatagagtatggatagaagagaacccctggatggaagataagacccacgtgagtagctgggaggacgtcccatacttaggaaaacgcgaggaccagtggtgtggctcgctgatcggcttgactgcccgggctacatgggccaccaatattcaggttgcaatcaaccaagtgaggcgactgattgggaatgaaaactatctcgattacatgacttccatgaagagatttaaaaatgactctgatcccgagggagctctttggtga

SEQ ID NO: 13178 - RNA, 9879 nt, synthetic construct
  misc_feature 1..9879: note = derived and/or modified CDS sequence (opt3) from DENV-1__AB608786__SS-prME
  source 1..9879: mol_type = other RNA
agcgtgaccatgctgctcatgcttatgcccaccgccctggctttccacttgactacgagaggaggggaacctcatatgatcgtctccaagcaggaaaggggaaaatctttactgtttaagacctcagccggtgttaatatgtgcacgttaattgccatggacctcggcgagctgtgtgaagatactatgacctacaaatgcccacggataacggagaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgtgatcggcacctcgattacgcagaagggcatcatattcatcctcttaatgctggtcactccatcacttgccatgcgctgcgtggggattggaagcagagattttgtagagggtttgagtggcgctacatgggttgacgtggtcctggagcacgggtcctgtgtgaccactatggccaaggataaacccacactggacatcgaactcctgaagaccgaggtgacgaaccctgcggtccttaggaaactgtgcattgaagcaaagatctctaataccacaactgatagccggtgtccaacccaaggagaggccacattggttgaagaacaggacgctaacttcgtgtgccgccgaacttttgtagatagaggctggggtaatgggtgtggactcttcggcaaaggctccctgataacctgcgccaagtttaagtgcgtgacaaaattagaggggaagattgtccagtacgaaaacctgaaatattcagtgatcgttaccgtgcacactggagaccagcatcaagtcggtaatgagagtacggaacacggcacaaccgcaactattacaccccaggctcctacaaccgagatccagctcactgactacggggcccttacactggattgtagcccaaggacgggattggacttcaacgaaatggtgctactgaccatgaaggagaaatcttggctcgtacataagcagtggtttctggatcttccgctgccctggacttccggcgcgtcaacaagccaagagacctggaatcggcaggacttgctcgttacattcaaaactgcccacgcaaagaagcaggaagtggtcgtgctgggtagtcaagagggggctatgcacaccgccttaacgggcgctaccgaaatccagacatctggaactaccacaatttttgccggccatctgaaatgccgtctaaagatggataaactcactctgaaggggatgtcctatgtcatgtgtaccggtagcttcaaacttgagaaggaagtggcagagacgcagcacggaacagttttggtgcagataaagtacgagggcaccgacgccccttgcaaaatcccattctcgactcaagatgaaaagggggtaacacagaacggacgcctgattaccgctaatcccatcgtcactgacaaagagaagcctgtgaacatagaagcggagccaccctttggcgagtcttatattatcatcggtgcaggggaaaaagccctcaagctgtcctggttcaagaaaggctcaagtattggaaagatgtttgaggctaccgccagaggcgcaaggcggatggccatccttggggatacagcttgggacttcggaagcattggtggcgtttttacgtccgtggggaaactggtccatcagatattcggaaccgcctacggcgtgttgttttctggtgtaagctggactatgaagatcgggattggcgtgctcctgacatggttaggactaaattcacgaagtacctccctaagcatgacatgtatcgcagttggcctcgtcactctgtaccttggggtgatggtgcaggcggattctggatgcgtcatcaactggaaaggccgcgaattgaagtgtggttcagggattttcgttaccaatgaggtgcacacgtggacagaacaatataagtttcaggctgacagtccgaaaagactgagcgccgcaataggaaaggcctgggaggagggcgtgtgcggtatcaggtccgctacccggctcgaaaacattatgtggaaacagatctctaacgagctgaatcatattttactggaaaacgacatgaagttcactgtagtcgtgggcgatgttgccgggatccttgcacagggcaagaagatgatacgccctcaacccatggagtacaaatattcgtggaaaagctggggcaaggctaaaatcattggggccgacgtgcagaataccacatttatcattgatggaccaaacactcctgaatgtcccgacgatcagagagcgtggaatatctgggaggtcgaggactacggcttcggtatatttaccacaaacatttggttgaagctcagggattcctatacacaggtgtgcgaccaccgtctgatgtcagccgctatcaaagatagtaaggcagttcacgccgacatggggtactggattgaatctgagaaaaatgaaacctggaagctagctcgggccagcttcatcgaggtgaagacttgtatatggccaaaatcccatacactgtggtcaaacggagtactcgaaagcgagatgatcattcccaagatctatggcggtcctatttctcaacacaattaccgaccaggctacttcacccagactgcagggccgtggcatctgggaaaacttgagttggattttgacctgtgcgaaggcacaaccgtcgtggtggatgagcactgcgggaacagaggaccctccttaaggacgactaccgtcacaggcaagatcatacacgaatggtgttgccgcagttgtaccctccctccactgcggttcagaggtgaggacgggtgctggtatggaatggagattaggcccgttaaagaaaaggaggaaaatcttgtgaagtccatggtatctgcgggctccggtgaggtggactcatttagtctgggcttgctctgtatcagcatcatgattgaagaggtcatgcgctcgcgatggtcccggaaaatgctgatgactgggacactagccgtgttctttctgctcatcatgggacagctgacctggaacgatcttattcgtttgtgcataatggttggcgctaatgcctctgacagaatggggatgggaacaacttacctggcattaatggctaccttcaagatgaggcctatgtttgccgtgggcctcctgttccgccggcttacgagcagagaggtcctgctactcacaatcggtctgtcattggtggcaagtgttgaactgccaaactccttagaggaactcggggatggactggccatgggcattatgatccttaaactgttgaccgactttcaatctcatcagctctgggctactctgctaagcctgaccttcattaagacaactttttcccttcactatgcgtggaaaaccatggccatggtgctctcaatcgtcagcctgttccccttgtgtctgagtacgacatctcagaagaccacttggttaccggtactcctgggctcccttgggtgcaagcctctgacaatgtttttgatagcagagaataaaatctggggaagaaagagctggccactcaacgaaggtattatggctgtgggcatcgtttcgattctgctatcatctctgcttaaaaacgatgtgcccctcgccgggcctctgatcgccggaggcatgttgatagcttgttacgtcattagtggttccagcgcagacttatctctggagaaggccgcggaggtgagctgggaagaggaagctgagcattccggggcctcacacaatatcctcgtagaagtgcaggatgacggaaccatgaaaatcaaggatgaggagcgagacgatactctgacaattcttctgaaagcaaccttgctagccgtcagtggcgtttatcccctgagcataccagctacactcttcgtgtggtacttctggcaaaagaagaaacagcgctctggcgtgctgtgggacactccttcacccccagaagtcgagcgggcagtgcttgatgacgggatctatagaattatgcagaggggattactgggtcgtagccaggttggcgtaggggtgtttcaagaaaacgtcttccataccatgtggcacgtgacacgcggagccgttctcatgtaccagggcaagcggttggagccgagttgggcgagcgtgaaaaaggacctgatctcctacggtgggggatggagactccagggctcttggaataccggcgaggaagtccaggtgattgctgtagagcctgggaaaaaccccaagaatgtccaaacagccccaggaacttttaagacccccgaaggtgaggtgggcgcaatcgccctggatttcaaacctgggacgtcgggaagcccaatagttaacagggaaggcaagatcgtgggtctttatgggaatggagtcgtgacaacttcaggcacctacgtttccgctattgcccaggcaaaagctagtcaggagggccccctgcctgagatcgaagacgaggtgtttcgaaagcggaacttgacaattatggatctacacccggggtctggaaaaacccgcagatatctgccagccatcgtcagggaagcgataaagcggaagctccgaactttaattctggcccccaccagagtggtagcaagcgagatggctgaagcccttaaaggtatgcctatccgctaccaaacaacggctgtgaagtccgagcatactggcaaagagatcgttgacctgatgtgccacgcaaccttcacaatgaggctcttgtcaccagtccgtgtgcccaattataacatgattatcatggatgaagcccattttaccgacccttctagcatagccgctcgggggtacattagtactagagtgggaatgggcgaggcggcagccatcttcatgacagctaccccgcccggttccgtcgaagcctttccacagagcaatgcagtaattcaggatgaggaaagggacatccctgagcgctcttggaactcagggtatgagtggataacggatttccccggaaagactgtgtggtttgttccatccattaaaagtggcaatgacatcgccaactgtctgcgaaagaatggcaagagagtgatccagctcagccggaaaacattcgataccgaataccaaaagaccaaaaacaacgactgggactacgtcgtgactacagatatttcggagatgggggctaatttcagggcggaccgcgttatcgatcctcgtagatgcctgaagcccgtgattcttaaagacggaccagaacgggtcatactagccggtccgatgcctgtgaccgtagcatctgctgcccagaggcgcggccgaatcgggagaaaccacaataaggagggagatcagtatatttacatgggccagcccctgaacaatgacgaggatcatgcacactggacagaagccaagatgttgttagacaacatcaatactccagagggtatcattcccgctctgtttgaacctgagcgggaaaaatccgccgcgatagatggggagtataggctccgcggcgaggcaagaaagacgttcgtggaactgatgaggcggggagaccttccagtttggctgagctacaaagtcgcctcagagggctttcaatatagtgatcgtcgctggtgcttcgacggggaacgaaacaatcaggtgctcgaggaaaacatggatgtggagatctggaccaaggagggagaaaggaaaaagttgaggccccggtggctggacgctcgcacatactctgaccctctagccctgagagagtttaaagagttcgctgcaggtaggcggtccgtcagcggcgatctcattcttgagatcgggaagctgccgcagcacttaactcagcgagcccaaaatgctttggacaacctggttatgctccataattcagaacagggaggcagagcctatcgccacgcaatggaggagctgccagataccattgaaacacttatgctgctcgcgttgatcgccgtgctgaccggtggggtaactttatttttcctaagtggcaggggactgggcaagacgagcatagggctcctttgtgtgatggcttcctctgtcctgttgtggatggccagcgtggagccccattggatcgcagcttccattatcctggaatttttcctcatggttctgcttattcctgagcccgaccggcagcgtaccccacaggataaccaactcgcctacgtggtcatcggactgttgtttatgatactgacagtagcagccaatgagatgggtttactagaaactaccaaaaaggacctgggcattgggcacgtggctgttgagaaccaccatcacgcggccatgctcgatgtggaccttcatcctgcatcagcttggacactgtacgccgtcgccaccactatcattacacccatgatgagacacacgatcgaaaacaccactgcaaatatatctttgacagctatcgccaaccaggcggctattctgatgggactcgataaaggctggccaatcagtaagatggacattggtgtgcctctgcttgccttagggtgctattcgcaggtcaatccgctgaccctcaccgcagccgtgttgatgctggttgctcattacgcaatcataggccccggactacaagccaaagcgacaagggaggctcagaagcgcactgccgcaggcattatgaagaacccaacggtggatgggatcgtagccatcgacctggatcctgtggtctatgacgctaaattcgaaaagcagctcggacagattatgcttctgatcttgtgtaccagccaaatactgctcatgcggacaacttgggccctgtgcgagtccattaccttagcaacaggcccccttaccactctgtgggagggttctccagggaaattttggaatacgacaatcgctgtttcaatggccaacattttccgaggaagctacctcgcgggcgccggtctagcattctccctgatgaagagtttgggcgggggaagaaggggcaccggggctcagggagaaactctgggcgagaaatggaagcgccagctcaatcagctttctaagagcgaatttaacacctataaaggttcagggatcatggaggtggaccggtccgaagccaaggagggactgaaaagaggcgagacaactaagcacgcagtcagtcgtggtaccgctaaattgaggtggttcgtggaacggaatctggtaaagcctgagggcaaggtgatagatctcgggtgtggacgcggcgggtggagctactattgcgccggactaaagaaggttacagaagtgaaaggctacacgaagggtgggcccggacacgaggaaccgatcccaatggccacctacggctggaacctggtcaaacttcattctggcaaggacgtgtttttcattcctcccgagaaatgtgatactctgctatgcgacatcggggagtcctcaccaaatcccacaattgaagagggacgaaccctcagagtcctgaagatggtggaaccttggttgaggggtaaccaattttgtatcaagattctgaatccgtatatgcccagcgttgtagagactctcgagcagatgcagcggaaacacggcgggatgcttgtgcgcaacccactgtcgagaaattctacacatgaaatgtactgggtcagttgcggaaccggcaacatcgtgtccgcggttaatatgacgagcaggatgttactgaaccgattcaccatggctcaccggaagcctacatatgagcgtgatgtggacttgggtgcagggactagacacgtcgccgtggaacccgaggtagctaacctcgatataattggacagcgcatcgaaaatatcaaacatgagcacaagtcaacctggcattacgacgaggataacccttataaaacatgggcctaccacggctcctatgaagtgaagccatctggcagcgcaagttccatggttaatggggtcgtgaagctgctaactaaaccctgggacgtgattcctatggtcacccaaatagccatgacagataccactccatttggacagcagagggttttcaaggagaaagtggacacgcggacacccaaggctaaaagaggtaccgcgcaaatcatggaagtaactgccaagtggctttggggctttctgagccgcaacaagaaaccgaggatttgtacccgagaggagttcacacggaaggtgagatctaatgcagctatcggggccgtctttgtggacgagaaccagtggaactcagcaaaagaggccgttgaagatgagaggttctgggacctcgtgcatcgcgaacgtgagctgcacaagcagggaaaatgcgctacgtgcgtctacaacatgatgggcaagcgggaaaagaaattgggtgagtttgggaaggccaaaggaagtagagcgatttggtacatgtggctgggcgcaaggttcctcgagttcgaagcccttggctttatgaatgaggatcactggttctcccgcgaaaacagcctgtctggggtggagggagagggtttacataagctgggctatatcttgcgagacatatcgaaaatccctgggggaaatatgtacgctgatgacaccgccggctgggatactcggattacagaagacgatctccagaacgaggcaaagatcaccgacattatggaaccagagcacgctctgctagccaaatcaatctttaaacttacttatcaaaataaggtagttagagtgcagaggcccgctaaaaacggtacagtcatggatgtgataagccgcagagaccagcgggggtccggacaggtgggcacctacggcctgaatacattcactaacatggaagcccaactcattaggcagatggagagtgaggggatcttttctcctagcgaactggagaccccaaacttggcagaacgtgtcttagattggctggagaagtatggagttgaacgactcaaacgcatggcgatctccggtgacgactgtgtggtaaagcccattgatgacagattcgccacggctcttaccgccctgaatgatatgggcaaagtgcggaaggacataccgcagtgggagccttcaaaggggtggaacgattggcagcaagtccccttttgcagtcatcacttccaccagctaatcatgaaagacggaagggagattgtggttccatgtcgcaatcaggatgaactggtgggcagagcacgggtctctcagggtgctgggtggagcctcagggagacagcctgcttgggaaagtcctacgcacaaatgtggcagctgatgtattttcatcgacgtgaccttagactggccgcgaacgctatctgttcagccgtgcctgtagattgggttcccactagccgcaccacatggtctattcacgcacatcaccagtggatgactaccgaagacatgctctccgtgtggaatcgggtctggatcgaggaaaacccatggatggaggataaaacgcatataagtagctggggcgacgtgccctacttaggcaagagggaggaccaatggtgcgggtcgctgatcggattgacagccagagctacctgggccactaatattcaggttgcaatcaaccaggtgcgccggctgattggtaatgaaaactacctcgattatatgacatccatgaaaaggttcaagaatgagtctgaccctgaaggcgctctttggtga

SEQ ID NO: 13179 - RNA, 9879 nt, synthetic construct
  misc_feature 1..9879: note = derived and/or modified CDS sequence (opt3) from DENV-1__AB608787__SS-prME
  source 1..9879: mol_type = other RNA
agcgtgacaatgctgctcatgcttatgcccacagcactggctttccacttgactacgcggggaggggaacctcatatgatcgtctccaagcaggaaaggggaaaatctttactgtttaagacctcagccggtgttaacatgtgcacattgattgccatggacctcggagaactgtgtgaagatactatgacctacaaatgcccacggattacagaggcggaaccggacgatgtggactgttggtgcaatgctaccgatacttgggtaacatatgggacctgtagtcagacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagccgggattttgtggagggtcttagtggcgcgacttgggtagacgttgtgttggagcacgggtcctgtgtcacaaccatggcaaaggataaacccactctggacatcgaactgctcaagacagaggtgaccaaccctgccgtgctgaggaaactttgcattgaagctaagatctctaatacgaccacagatagccggtgtccaactcaaggagaggccaccctggtcgaagaacaggacgcaaacttcgtttgccgccgaacatttgtggatagaggctggggtaatgggtgtggattgttcggcaaaggctccctcctgacttgcgctaagtttaagtgcgtaaccaaattagaggggaagatagtgcagtacgaaaacctgaaatattcagtcattgtgacagttcacaccggagaccagcatcaagtgggtaatgagagtactgaacacggcacgacagccaccatcactccccaggcgcctaccacagagattcagctcaccgactacggggcccttactctggattgtagcccaaggacaggattggacttcaacgaaatggtcctactgacgatgaaggagaaatcttggctcgtgcataagcagtggtttctggatcttccgctgccctggacctccggcgcatcaactagccaagagacatggaatcggcaggacttgctcgtaaccttcaaaacagctcacgccaagaagcaggaagttgtggtcctgggtagtcaagagggggctatgcacactgccttaaccggcgcaacggaaatccagacctctggaacaactaccatctttgccggccatctgaaatgccgtctaaagatggataaactcacactgaaggggatgtcctatgtgatgtgtactggtagcttcaaacttgagaaggaagtcgctgagacccagcacggtacggtgttggttcagattaagtacgagggcacagacgcgccttgcaaaataccattctcgacccaagatgaaaagggggtgactcagaacggacgcctgatcacagcaaatcccattgtaaccgacaaagagaagcctgtcaacatcgaagccgagccaccctttggcgagtcttatatagtgattggtgctggggaaaaagccctcaagctgtcctggttcaagaaaggctcaagtatcggaaagatgtttgaggcaactgccagaggcgctaggcggatggccatccttggggataccgcatgggacttcggaagcattggtggcgtttttacatccgtggggaaactggtccatcagatcttcggaacggcgtacggcgtgttgttttctggtgtaagctggaccatgaagattgggataggcgtgctcctgacttggttaggactaaattcacgaagtacatccctaagcatgacctgtatcgctgttggcctcgtcacactgtaccttggggtgatggtgcaggccgattctggatgcgtcattaactggaaaggccgcgaattgaagtgtggttcagggatcttcgttactaatgaggtgcacacctggacggaacaatataagtttcaggcagacagtccgaaaagactgagcgccgctatcggaaaggcctgggaggagggcgtgtgcggtattaggtccgcaacacggctcgaaaacataatgtggaaacagatctctaacgagctgaatcatattttactggaaaacgacatgaagttcaccgtagtcgtgggcgatgttgctgggatccttgcccagggcaagaagatgattcgccctcaacccatggagcacaaatactcgtggaaaagctggggcaaggcgaagatcataggggccgacgtgcaaaattccacttttatcattgatggaccaaacacccctgaatgtcccgacgatcagagagcttggaatatctgggaggtcgaggactatggcttcggtatttttacaactaacatctggttgaagctcagggattcatacacccaggtgtgcgaccaccgtctgatgagtgcagccataaaagattctaaggctgttcatgccgacatggggtattggattgaaagcgagaaaaatgaaacatggaagctagcacgggcgtccttcatcgaggtgaagacgtgtatttggccaaaatcacacaccctgtggagcaacggagtactcgaatctgagatgatcatacccaagatctacggcggtcctatttcccaacataattatcgaccaggctacttcactcagacagccgggccgtggcacctgggaaaacttgagttggattttgacctgtgcgaaggcaccactgtcgtggtggatgagcactgcgggaacagaggacccagtttaaggacaaccacggtcactggcaagatcgttcatgaatggtgttgccgcagctgtaccctccctccactgcggttcagaggtgaggacgggtgctggtacggaatggagattaggcccgtgaaagaaaaggaggaaaatcttgtaaagtctatggtgtccgctggctcaggtgaggtcgacagttttagcctgggcttgctctgtatctcgataattatcgaagaggtgatgcgctcccgatggatccggaaaatgctgatgacagggaccctaggagttttctttctgctcattatgggccagctgacttggaacgatcttatccgtttgtgcattatggtgggggccaatgcatctgacagaatgggaatgggcacaacctatctggctttaatggccacattcaagatgaggcctatgtttgcagtcggtctcctgttccgccggcttactagcagagaggtgctgctactcaccatagggctgtcattggttgccagtgtggaactgccaaactccttagaggaactcggagatggcctggctatgggcatcatgattcttaaactgttgacggactttcaatctcaccagctctgggcgacactgctaagcctgaccttcatcaagactaccttttcccttcattacgcctggaaaacaatggcaatggtcctctcaattgtaagcctgttccccttgtgtctgagtactacctctcagaagacgacatggttaccggtgctcctggggtcccttggatgcaagcctctgaccatgtttttgatcgctgagaataaaatatggggtagaaagtcctggccactcaacgaaggcatcatggccgttgggattgtgtcgatcctgctatcatctctgcttaaaaacgatgtccccctcgccggacctctgattgctggcggtatgttgatcgcatgttatgtgataagtgggtccagcgccgacttatctctggagaaggcggctgaggtaagctgggaagaggaagccgagcactccggagcatcacataatattctcgtggaagtccaggatgacggcactatgaaaatcaaggatgaggagcgagacgatacactgaccatccttctgaaagccactttgctagctgttagtggcgtgtaccccctgagcattccagcaacactcttcgtgtggtatttctggcaaaagaagaaacagcgctctggggtcctgtgggacaccccttcacccccagaagtggagcgggccgttcttgatgacggaatatacagaatcatgcagaggggtttactgggccgtagccaggtaggggtgggagtctttcaagaaaacgtgttccacacgatgtggcacgttactcgcggcgcggtgctcatgtatcagggtaagcggttggagccgagttgggctagcgtcaaaaaggacctgatttcctacgggggaggctggagactccagggctcttggaataccggggaggaagtgcaggtaatcgccgtcgagcctggcaagaatcccaagaatgtgcaaacagcaccaggtacctttaagacacccgaaggcgaggttggggccattgctctggatttcaaacctggaacttcgggcagcccaatcgtgaacagggaaggtaagatagtcgggctttacggaaatggcgtggttaccacgtcaggcacatatgtgtccgccatcgcacaggctaaagccagtcaggaggggcccctgcctgagattgaagacgaggtctttcgaaagcggaacttgactatcatggatctacatccgggatctggtaaaacccgcagatacctgccagcgattgtgagggaagccatcaagcggaagctccgaacattaatactggcacccaccagagtagtggctagcgagatggccgaagctcttaaaggcatgcctattcgctatcaaactaccgcagttaagtccgagcacacagggaaagagatcgtcgacctgatgtgccatgccacgttcactatgaggctcttgtcaccagtgcgtgtgcccaattacaacatgatcattatggatgaagcccactttaccgacccttctagcatcgctgcgcggggatatataagtacaagagtcggcatgggtgaggcagccgctattttcatgaccgccactccgcccgggtccgtagaagcatttccacagagcaatgccgtgatccaggatgaggaaagggacattcctgagcgctcttggaactcaggatacgagtggatcacagatttccccggcaagaccgtttggtttgtgccatccataaaagctggcaatgacattgcgaactgtctgcgaaagaatgggaagagagtcatccagctcagtcggaaaacgttcgatactgaatatcaaaagaccaaaaacaacgactgggactacgtggttaccaccgatatcagcgagatgggagccaatttcagggcagaccgcgtgattgatcctcgtagatgcctgaagcccgtcatccttaaagacggtccagaacgggtgattctagctggcccgatgcctgtaactgtggcctcggcagcccagaggcgcgggcgaataggaagaaaccataataaggagggcgatcagtacatctatatgggtcagcccctgaacaatgacgaggatcacgctcactggacagaagccaagatgttgttagacaacattaataccccagaggggatcatccccgcgctgtttgaacctgagcgggaaaaatctgcagccattgatggcgagtacaggctccgcggagaggctagaaagacattcgttgaactgatgaggcggggcgaccttccagtctggctgtcctataaagtggccagcgaggggtttcaatactcagatcgtcgctggtgcttcgacggagaacgaaacaatcaggtgctcgaggaaaacatggatgtcgagatatggactaaggagggtgaaaggaaaaagttgaggccccggtggctggacgctcgcacgtatagtgaccctctagcactgagagagtttaaagagttcgccgctggcaggcggtctgtttccggggatctcatccttgagattggaaagctgccgcagcatttaacccagcgagcccaaaatgcattggacaacctggtgatgctccacaatagcgaacagggcggtagagcgtaccgccatgccatggaggagctgccagatacaatcgaaactcttatgctgctcgctttgattgccgtactgaccgggggcgtgacattatttttcctatcaggaaagggcctggggaaaaccagtatcggactcctttgtgtcatggcaagctccgtgctgttgtggatggcttctgttgagccccactggatagccgcaagcatcattctggaatttttcctcatggtgctgcttatccctgagcccgacaggcagcggactccacaggataaccaactcgcctatgtcgtaattggtctgttgtttatgatcctgacggtggctgcgaatgagatgggcttactagaaaccacaaagaaagacctggggataggacacgttgccgtggagaaccatcaccatgcagctatgctcgatgtcgaccttcaccctgcctccgcctggactctgtacgcagtggctaccacaattatcacccccatgatgcgtcatactattgaaaacacaacggccaatatctcattgaccgcgatagctaaccaggccgcaatcctgatgggcctcgataagggttggccaatttctaaaatggacatcggggtccctctgcttgccttaggctgctacagtcaggtgaatccgctgactctcacagctgcagttttgatgctggtggcccactatgcgattatcggacccggcctacaagctaaggccaccagagaggcacagaagaggaccgccgctgggataatgaaaaacccaacagtagatggaattgtggccatcgacctggatcctgtcgtttacgacgcaaagttcgaaaaacagctcggccagatcatgcttctgattttgtgtacttcgcaaatcctgctcatgcgcacgacctgggctctgtgcgagagcataacattagccactggtccccttaccacactgtgggaggggtccccaggaaagttttggaataccactattgcggtgtctatggccaacatcttccggggctcatatctcgcaggagctggcctagccttcagcctgatgaaatccctagggggaggccgaagagggacgggagcacagggcgaaacactgggtgagaagtggaagaggcagctcaatcagcttagtaaatctgaatttaacacctacaaggggagcggaattatggaggtcgaccgctcagaagctaaagagggcctgaagcggggtgagactaccaaacacgccgtgtccagaggcacagccaagttgcgttggttcgtagaaaggaatctggtgaagcctgaggggaaagttatcgatctcggatgtggcagagggggatggagttattactgcgcgggcttaaagaaagtgactgaagtcaagggttataccaaagggggacccggccatgaggaaccgataccaatggctacatacggctggaacctggtgaaacttcacagcgggaaagacgtctttttcatccctcccgagaagtgtgatacgctgctatgcgacattggagagtcttccccaaatcccaccatcgaagagggtcgcactctccgagtgctgaagatggttgaaccttggttgaaaggcaaccaattttgtattaagatcctgaatccgtacatgccctcagtagtggagacactcgagcagatgcagagaaaacatgggggaatgcttgtcaggaacccactgagcagaaattcgacccacgaaatgtattgggtgtcttgcggcactggtaacattgttagtgcagtgaatatgacatcccgcatgttactgaacagattcaccatggcccacaggaagcctacgtacgagcgagatgtcgacttgggggctggaacccggcatgtggccgtagaacccgaggtggcaaacctcgatatcataggccagcgtattgaaaatatcaaacacgagcataagagcacatggcactatgacgaggataacccttacaagacttgggcctatcatggctcatacgaagttaaaccatccgggtctgctagcagtatggtcaatggagtggtgaagctgctaaccaaaccctgggacgtcatccctatggttacacaaattgcgatgactgataccacaccatttggtcagcagagagtgttcaaggagaaagtagacacccgcactcccaaggccaagaggggcacggcacaaataatggaagtgacagctcggtggctttggtcctttctgagcagaaacaaaaagccgcgcatctgtaccagggaggagttcactcgaaaagtccggtctaatgccgcaattggggccgtgtttgttgacgagaaccagtggaactcagctaaggaggccgtggaagatgagagattctgggacctcgtccacagggaacgcgagctgcacaaacagggaaagtgcgcgacctgcgtgtataacatgatgggcaagcgtgagaaaaagttgggtgagtttgggaaagcaaagggaagtcgggccatctggtacatgtggctgggcgctagattcctcgagttcgaagcccttggctttatgaatgaggatcattggttctccagggaaaacagcctgtctggggtagagggagagggtttacacaaactgggctacattttgcgcgacatctcgaagatacctgggggaaatatgtatgcagatgacacagctggctgggatacgcgaatcaccgaagacgatctccagaacgaggccaaaattactgacatcatggaaccagagcatgctctgctagccaagtcaatttttaaacttacataccaaaataaagttgtgcgggtccagagacccgcaaagaacggtaccgtgatggatgtgatcagcaggcgcgaccagagagggtccggacaggtcggcacttatggcctgaatacattcaccaacatggaagcgcaactcatacggcagatggagagtgaggggatattttctcctagcgaactggagacaccaaacttggccgaaagggttttagattggctggagaaatacggagtggaacgtctcaagcgaatggctatctccggtgacgactgtgtagtgaaacccatcgatgaccgcttcgccactgcacttaccgctctgaatgatatgggcaaggtcagaaaggacattccgcagtgggagccttcaaaagggtggaacgattggcagcaagtgcccttttgcagtcaccacttccatcagctaataatgaaggacggacgggagatcgttgtgccatgtaggaatcaggatgaactggtcggccgcgccagagtgtctcagggtgcagggtggagcctccgggagacggcctgcttgggaaaatcctatgcgcaaatgtggcagctgatgtactttcacaggcgagaccttcgtctggctgccaacgcaatttgttcagccgtacctgttgattgggtgcccaccagcagaacaacttggtctatccatgctcaccatcagtggatgaccacagaagacatgctctccgtctggaatcgcgtgtggattgaggaaaacccatggatggaggataagactcacatcagtagctgggaggacgttccctatttaggcaaacgggaagaccaatggtgcggctcgctgatagggttgaccgccaggcctacgtgggcaacaaatatccaggtggctattaaccaggtcagacgcctgatcggaaatgagaactacctcgattacatgacctccatgaagcggttcaagaatgaatctgagccagagggtgccctttggtga

SEQ ID NO: 13180 - RNA, 9879 nt, synthetic construct
  misc_feature 1..9879: note = derived and/or modified CDS sequence (opt3) from DENV-1__HE795086__SS-prME
  source 1..9879: mol_type = other RNA
agcgtgacaatgctgctaatgcttatgcccacagcactggctttccacttgactacgcgaggcggggagcctcatatgatcgtctccaagcaggaaaggggaaaatctttactgtttaagacatcagccggtgttaacatgtgcacactaattgcaatggacctcggcgagttctgtgaagatactatgacctacaaatgcccacggataacagaggcggaaccggacgatgtggactgttggtgcaatgctaccgatacttgggtaacatatgggacctgtagtcagacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggttgacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagaacaagacgcaaactttgtttgccgccgaacattcgtggatagaggctggggtaatgggtgtggactgtttggcaaaggctccttgataacttgcgctaagttcaagtgcgtaaccaaactcgaggggaagattgtgcagtacgaaaacctgaaatattcagtcatcgtgacagttcacaccggagaccagcatcaagtgggtaatgagagtactgaacacggcacgacagccaccattactccccaggcgcctagcaccgagatccagttaacagactacggggccctgaccctcgattgttctccaaggactggacttgactttaacgaaatggtcctgttgacaatgaaggagaaatcctggctagtgcataagcagtggttcctggatctcccgctgccctggacgtcaggcgcaagcaccagtcaagagacttggaatcggaaagaccttctggtaacatttaagaccgctcacgccaagaaacaggaagttgtggtcttgggttctcaggagggggctatgcacacagccctcactggcgcaaccgaaatccaaacgtccggaaccacaactattttcgccggccatctgaagtgccgtttaaaaatggataagctgaccctaaaagggatgagctatgtgatgtgtacaggatcgttcaagctcgagaaggaagtcgctgagactcagcacggtaccgtgctggttcagataaaatacgagggcacggacgcgccttgcaagatcccattttctacacaggatgaaaaaggggtgacccaaaacggacgccttattactgcaaatcccatcgtaacagacaaggagaaacctgtcaacatagaagccgagccacccttcggcgagtcctatattgtgatcggtgctggggaaaaggccttgaagctgtcatggtttaaaaagggcagtagcatcggaaaaatgttcgaggcaaccgccagaggcgctaggcggatggccattctcggggatactgcatgggactttggatccatcggtggcgttttcacctctgtggggaagctggtccatcagatttttggaacagcgtacggcgtgcttttcagcggtgtatcatggacgatgaaaatagggatcggcgtgctgttgacctggctcggactgaatagtcgatccactagcttatctatgacatgtattgctgttggcctggtcaccctatacctcggggtgatggtgcaggccgattcaggatgcgtcatcaactggaagggccgcgaactgaagtgtggtagtgggatctttgttacaaatgaggtgcacacttggaccgaacagtataaattccaagcagacagcccgaagagactttccgccgctattggaaaagcctgggaggagggcgtgtgcggtgtaaggtctgcaacgcggttggaaaacataatgtggaagcagatctcgaacgagctgaatcatattctcctggaaaacgacatgaaatttacagtcgtggttggcgatgtggctgggatcttagcccagggaaagaaaatgattcgccctcagcccatggagtacaagtatagctggaagtcctggggcaaagcgaagatcataggggccgacgtccaaaataccactttcatcattgatggaccaaacacccctgaatgtcccgacgatcagagagcttggaatatctgggaggtggaggactacggctttggtattttcacaactaacatctggctgaaacttagggattcatatacccaggtttgcgaccaccgtttgatgagtgcagccataaaggattctaaagctgtgcacgccgacatggggtactggattgaaagcgagaagaatgaaacatggaagctcgcacgggcgtccttcatcgaggtaaaaacgtgtatttggccaaagtcacataccctgtggagcaacggagtcctagaatctgagatgatcatacccaaaatctatggcggtcctatttcccagcacaattaccgaccaggctactttactcaaacagccgggccgtggcatctgggaaagctcgagctggatttcgacctttgcgaaggcaccactgtggtggtcgatgagcactgcgggaacagaggacccagtttgaggacaaccacggttactggcaaaatcattcacgaatggtgttgccgcagctgtaccctgcctccattacggtttaagggtgaggacgggtgctggtatggaatggagatcagacccgtgaaggaaaaagaggaaaatctcgtaaagtctatggtgtccgctggctcaggtgaggtcgacagtttcagcctgggccttctgtgtatatcgattatgatcgaagaggtgatgaggtcccgctggtctcgaaaaatgttgatgacagggaccctcgccgtatttttcctgctaatcatgggacagctgacttggaacgatctcattcggctgtgcatcatggtgggcgcaaatgctagcgaccgtatggggatgggaacaacctaccttgccttgatggcaacatttaagatgagacctatgttcgccgtcggcctgttatttaggcgcctcacttcacgggaggtgctgcttctgaccattggtctaagtctcgttgcttccgtggaactgccaaactctttggaggaactgggggatggattagcgatgggcataatgatcctcaaactgcttacggacttccagagccatcaactgtgggccacattgctctccctgacctttattaagactaccttctcactacactatgcatggaagacaatggctatggtcctgagcatcgtaagtctttttcccctctgtctgtctactacctcccagaaaacgacatggttgccggtgctgttaggcagcctcgggtgcaagcctctgaccatgttccttattgccgagaataaaatctggggaagaaagtcgtggccactgaacgaaggtataatggccgttggcatcgtgtcaattttgctctctagtctgctcaagaatgatgtccccctggctgggcctcttatcgcaggaggcatgctcattgcctgttacgtgatctccggtagctctgcggacctgagcttggagaaggctgccgaggtatcctgggaagaggaagcagagcattcaggggccagtcacaatatattagtggaagtccaggatgacggaactatgaaaattaaggatgaggagagggacgatacactgaccatcctcctgaaggctactcttctggcagttagcggcgtgtatcccttgtctatcccagccacactattcgtgtggtacttttggcagaaaaagaaacaacgatccggcgtcctgtgggacaccccttcacccccagaagtggagcgcgcggttctcgatgacgggatttatcggataatgcagagaggactgcttggtaggagtcaggtaggcgtgggggtcttccaggaaaacgtgtttcatacgatgtggcacgttactcgtggagctgtgttaatgtaccaaggcaagcgcctggagccgagctgggcctccgtcaaaaaggacctcatctcttacggtgggggatggcggttgcagggctcgtggaataccggcgaggaagtgcaggtaattgcagtcgagcctgggaagaaccccaaaaatgtgcagacagccccaggaaccttcaagacaagcgaaggtgaggttggcgctatcgccctggattttaaacccgggacttcaggatcccctattgtgaacagagaaggcaagatcgtcggtctctatgggaatggagtggttaccacgagtggcacatacgtgtctgcaatagctcaagccaaagcgagccaggacggcccactgcccgagatcgaggatgaagtcttcaggaagcgaaaccttactattatggacctgcaccctgggtccggaaagacccggcgctatttgccggccatcgtgagagaggcaattaaaaggaagctacggacactgatcctcgctccaacccgagtagtggcctcagaaatggctgaggcattaaaaggtatgcccataagataccagactaccgccgttaagtctgaacatacaggcaaagagattgtcgatctgatgtgccacgccacgtttactatgcgccttctgagccctgtgagggtgccaaattataacatgatcatcatggacgaggctcatttcaccgatcccagttccattgcggcacgtgggtacatcagcacacgggtcggaatgggcgaagccgctgccatatttatgaccgcaactcctccgggttctgtagaggccttcccccaatcaaatgctgtgattcaggacgaagagagagatatcccagaaaggtcctggaacagtgggtatgagtggattacagactttcctggaaagaccgtttggttcgtgcccagcatcaagtcgggcaatgatatagcgaactgtctccgcaaaaatggcaagcgagtcattcagttgtctagaaaaacgttcgacactgagtaccagaagaccaagaacaacgactgggattacgtggttaccaccgacatctccgaaatgggggccaattttcgggcagatagggtgatcgacccacgccgttgcctgaagcctgtcattctcaaggatggacccgagagagtgatcctggctggtccaatgccggtaactgtggccagcgcagcccaacggaggggccgcattgggcgaaaccacaataaagaaggagaccagtatatatacatgggccagcctcttaacaatgatgaggaccatgctcactggacagaggccaagatgctactggataacatcaatacccccgaaggtattatcccagcgttgttcgagcccgaaagagagaaatcagcagccatcgacggggaatatcggttaaggggcgaggctcgcaagacatttgttgagctgatgagaaggggagatctccctgtctggctgagttacaaagtggcctctgaaggcttccagtattccgaccggcgttggtgctttgatggggagcgcaacaatcaagtgcttgaagagaacatggacgtcgaaatttggactaaggagggagagaggaaaaagctgagaccaagatggctcgacgctcggacgtacagcgatcccttggcactgcgcgagttcaaggagtttgccgctggtagaaggtcagttagtggcgacctaatactggaaatcgggaaactccctcagcaccttacccagcgggcccagaatgcactggataacttagtgatgttgcataatagcgagcaaggaggccgagcgtatagacacgccatggaagaactgccggacacaattgagactctcatgctgcttgctctgatcgccgtactcaccggtggggtgacattgttctttctgtccggccgcggattaggcaagacctctattgggctactgtgtgtcatggcaagctccgtgctcctttggatggcttcagttgaaccacattggatcgccgcatctataatcctggagttctttttgatggtgctgctcattcccgaacctgataggcagcggactccccaggacaaccagctggcctacgtcgtaatcggacttctcttcatgattctgacggtggctgcgaatgagatgggtttgctggagaccaccaaaaaggatttaggcatcgggcacgttgccgtggaaaaccaccatcacgcagctatgctagacgtcgatctgcatccagccagtgcctggactctctacgcagtggctaccacaataattacccctatgatgcgtcacactatcgagaacacaacggccaatatttcgcttaccgcgatcgctaaccaagccgcaatactgatgggattggacaaaggctggcccatcagcaagatggatattggtgtcccactgctcgccctggggtgctattcccaggtgaatcctcttactttaacagctgcagttctgatgctcgtggcccattacgcgatcattggcccgggattgcaggctaaggccaccagagaagcacagaaaaggaccgccgctggcatcatgaagaaccccacagtagacgggatagtggccattgatctggacccagtcgtttatgacgcaaaatttgagaagcagctaggacagatcatgctgctcatcctttgtacttctcagattctgttgatgcgcacgacctgggctctgtgcgaatcaatcacactcgccactggccctctgaccacattatgggagggtagccccgggaaattctggaataccactatagcggtgtccatggccaacattttccggggaagttaccttgcaggcgctggtctggccttttctctcatgaaaagcctaggcgggggacgaagaggcacgggggcacaaggagagacactgggcgaaaagtggaaaaggcagttgaatcagctgtcaaagtccgagttcaacacctataaacgcagtggtatcatggaagtcgatcggagcgaggctaaggaagggctcaaaagaggagagactaccaagcacgccgtgtctcgtggcacagccaaacttaggtggtttgtagagcggaatctggtgaaaccagaaggtaaggttattgacttgggctgtgggcgcggaggctggtcctactattgcgcggggctgaaaaaggtgactgaggtcaaaggatacaccaagggcggtcctgggcacgaggaacccatcccgatggctacatacggatggaacctcgtgaaattacattcaggcaaggatgtcttctttataccacctgaaaagtgtgacacgctgctttgcgatatcggcgagagctcgcccaatccaaccattgaggaagggcgaactctgagagtgctaaaaatggttgagccctggctcaggggaaaccagttctgtatcaagattctgaatccttatatgccgtctgtagtggaaacattggagcaaatgcagcggaaacacggtggcatgctggtccgcaaccccctcagtagaaattccacccatgagatgtactgggtgagctgcgggactggaaacatcgtttcagcagtgaatatgacatccaggatgcttctgaaccgatttaccatggcccaccggaagccaacgtatgaacgtgacgtcgatttaggcgctggtaccagacacgtggccgtagagcctgaagtggcaaacctggacattatcgggcagcgcatagagaatattaaatacgaacataagtctacatggcactatgatgaggacaacccctacaagacttgggcctatcatggaagctacgaggttaaacctagtggctccgctagctctatggtcaatggcgtggtgaagttgctcaccaaaccatgggatgtcatccccatggttacacagatcgcgatgactgacaccacacctttcgggcaacagagggtgtttaaggaaaaagtagacacccggactccaaaggccaagagaggaacggcacagattatggaggtgacagctaaatggctgtggggtttcctatcacgcaacaagaaacccaggatatgtacccgagaagagtttactcggaaggtcagaagtaatgccgcaatcggcgccgtgttcgttgatgaaaaccaatggaactccgctaaagaggccgtggaggacgaaaggttttgggatcttgtccaccgcgagcgtgaactgcataagcaggggaagtgcgcgacctgcgtgtacaacatgatgggaaaacgggagaagaaactcggcgagttcggtaaggcaaaagggagcagagccatttggtatatgtggctgggagctaggttcttggagtttgaggccctgggcttcatgaatgaagaccactggttttctcgcgagaactcgctctcaggcgtagaaggggagggacttcacaagctgggttacatcttacgagatattagcaaaatcccgggcgggaatatgtatgcagacgatacagctggatgggacacgcggataaccgaggatgacctgcagaacgaagccaagatcactgatattatggagcctgaacatgctttgctcgccaagtccatcttcaaactgacataccagaataaggttgtgagagtccaaaggccagccaaaaacggcaccgtgatggacgtgattagtcgcagagatcagcggggttctgggcaggtcggaacttatggcctaaatacatttaccaacatggaggcgcagcttatcaggcaaatggaaagcgagggcatattctccccctcagagctggaaacacctaacctcgccgggcgtgttctggactggttggagaagcacggagtggaacgattaaaacgcatggctattagtggtgacgattgtgtagtgaagccaatcgacgatagatttgccactgcactgaccgctctcaatgacatgggcaaggtccggaaagatatcccccagtgggagccgtctaaggggtggaacgactggcaacaggtgcctttctgcagccatcactttcaccaacttattatgaaagatggaagggaaatagttgtgccctgtcgcaatcaggacgagctggtcggcagagcccgggtgtcccagggtgcagggtggtcactaagggagacggcctgcctgggaaagagctacgcgcagatgtggcaactcatgtatttccatcgacgtgatttgagactggctgccaacgcaatctgttctgccgtaccagttgactgggtgcctacctcccgcacaacttggagtattcacgctcatcaccagtggatgaccacagaagatatgcttagcgtctggaatcgggtgtggatcgaggaaaacccctggatggaggacaaaactcatatttcgtcctgggaagacgttccatacctgggcaagagggaggatcagtggtgcggctctctcatcgggttaaccgccagagcaacgtgggctacaaatatacaagtggccatcaaccaggtccgccggctgattggaaatgagaactacttggactatatgacctcaatgaagaggtttaaaaatgaaagcgatcccgagggtgcgctgtggtga

SEQ ID NO: 13181 - RNA, 9879 nt, synthetic construct
  misc_feature 1..9879: note = derived and/or modified CDS sequence (opt3) from DENV-1__AB189120__SS-prME
  source 1..9879: mol_type = other RNA
agcgtgaccatgctgctcatgcttctgcccacagtattgactttccacttaacgaccagaggcggggaacctcatatgatcgtttccaagcaggaaaggggaaaatctctgttatttaagacatcagccggtgtgaatatgtgcactctcattgctatggacctgggcgaactttgtgatgacaccatgacatacaaatgcccgcggataaccgaaactgaaccggatgacgtagattgttggtgcaatgcaacagaaacctgggtgacgtatgggacttgtagtcaaaccggagagcaccgccgagacaagcgtagcgtcgccctggcgccccatgtgggcttgggtctcgagacaagaactgaaacctggatgtcctctgagggggcttggaggcagatccagaaagttgaaacatgggccctgcggcaccctggattcaccgtgattgcactgtttctcgcccatgctatcggcacgtcgattactcagaagggcatcatattcatcttactgatgcttgtcacaccatcaatggcaatgcgctgcgtggggattggaaatagagattttgtagagggtttgagcggcgccacctgggttgacgtggtcctggagcacgggagttgtgtgactacaatggctaaggataaacccaccttggacatcgaactcctgaagacggaggtgaccaatcctgccgtccttaggaaactgtgcattgaagcgaagatctccaacacaactaccgattctcggtgtccaacacaaggagaggcaactttggttgaagaacaagacgccaatttcgtgtgccgccgaacctttgtagatagaggctggggtaacgggtgtggactcttcggcaaaggcagcctgataacatgcgctaagtttaagtgcgtgaccaaattagaggggaagattgtccagtacgaaaatctgaaatattccgtgatcgttactgtgcacacgggagaccagcatcaagtcggtaacgagacaaccgaacacggcactattgccaccatcacaccccaggcacctacctcagagatccagctcactgactacggggctcttacactggattgtagtccaaggacgggattggacttcaatgaaatggtgctactgaccatgaaggagaaaagctggctcgtacataagcagtggtttctggatcttccgctgccctggacttctggcgcctccacatcacaagagacctggaaccggcaggacttgctcgttacattcaaaactgcgcacgccaagaagcaggaagcagtggtcctgggtagccaagagggggctatgcacaccgccttaacgggcgctaccgaaattcagacaagtggaactaccacaatatttgccggccatctgaaatgccgtctaaagatggataaactcactctgaaggggatctcttatgtgatgtgtaccggatccttcaaacttgagaaggaagtcgcagagacgcagcacggtacagtgttggttcaggtgaagtacgagggcaccgacgccccttgcaaaattccattcagctcgcaagatgaaaagggggtaactcagaatggacgcctggtcacagctaaccccatcgtgaccgacaaagagaagcctgttaatatagaagcggagccaccctttggcgagtcttatattgtggtcggtgcaggggaaaaagccctcaagctgtcctggttcaagaaaggctcaagtatcggaaagatgtttgaggctactgccagaggcgcaaggcggatggccatccttggggataccgcttgggacttcggaagcattggtggcgtgtttacatccgtagggaaactggtgcatcagatcttcggaacggcctacggcgttttgttttctggtgtcagctggaccatgaagattgggataggcatcctcctgacttggttaggactgaactcacgaagtacatccctaagcatgacctgtattgcagtgggcatggtgacactctacctgggggtcatggttcaggcggattctggatgcgtgatcaattggaaaggccgcgaacttaagtgtggttcagggatcttcgtgactaacgaggtacacacctggacggaacaatataagtttcaggctgacagtccgaaaagattgagcgccgcaattggaaaggcctgggaggagggcgtctgcggtataaggtccgctacacggctggaaaacatcatgtggaaacagatttctaatgagctcaaccatatcctgttagaaaatgacatgaagttcaccgtggttgtgggcgatgtctcggggattctggcccagggcaagaaaactatccgccctcaacccatggagcacaaatacagctggaagtcctggggcaaggcaaaaataatcggggctgacgtgcagaacaccacatttattatcgatggaccaaatactcctgaatgtcccgacgatcagagagcctggaacatttgggaggttgaggactatggcttcggtatctttaccacaaatatatggcttaagttgagggattcatacacacaggtgtgcgaccaccgtctcatgagtgcggccattaaagattctaaggctgtacatgcagacatggggtattggatcgaaagcgagaaaaacgaaacctggaagctggcccgggcttccttcattgaggtcaagacttgtgtgtggccaaaatcacacacactatggagcaatggagtgctggaatctgagatgatcatacccaagatctacggcggtcctatttcccaacataactatcgaccaggctacttcacccagactgccgggccgtggcacctcggaaaactggagcttgattttgacttgtgcgaaggcacaaccgtcgttgtggatgagcactgcgggaatagaggacccagtctgaggacgactaccgtaacaggcaagatcattcatgaatggtgttgccgcagctgtaccttacctccactccggttcaaaggtgaggacgggtgctggtacggaatggagatcagacccgtgaaggaaaaggaggaaaacctggtcaaatctatggtgtccgcaggctcaggtgaggttgacagttttagccttggcctgttgtgtatatcgattatgatcgaagaggtgatgaggtcccgctggtctcgaaagatgctcatgactgggacactggtcgtgttcctactgctcaccctgggacagcttacatggaatgatttgatccggctgtgcattatggttggcgcgaacgccagcgacaatatggggatgggaactacctatttagctctcatggccacgtttcgtatgagacctatgttcgcagtgggcctgctttttaggcgcctgacatcacgggaggtcctactcctgaccgtaggtttgagtctggtggcttccgttgaattaccaaactctctcgaggaactgggggatggacttgccatgggcatcatgattctgaaattgctcactgacttccaaagccaccagctgtgggcaaccctactgtcccttacatttgtgaagactaccctctcactgcattacgcctggaaaacgatggctatgatattgagcatcgtcagtctgttacccctctgtctgtctacaacctcccagaagactacatggcttccggtgctgttgggcagcctcgggtgcaagcctctgaccatgttcctaattactgagaacaaaatctggggaagaaagtcgtggccactgaatgaaggtattatggcggtaggcatcgtgtcaatacttctctctagtctgttgaaaaacgatgtccccttagccgggcctctgatcgcaggaggcatgctcattgcttgttatgttatctccggtagctctgccgacctgagccttgagaaggccgctaaagtgtcctgggaggaagaggcagaacactcaggggccagtcataatattctggtggagatccaggatgacggaacaatgaagataaaagatgaagagagggacgataccattacgatcttgctaaaggcgactctgctcgctatcagcggcgtctaccccatgtctattccagccaccctgtttgtgtggtatttctggcaaaagaaaaagcagcgatccggcgttctttgggacacaccttcacccccagaggtagaaaaagcagtgttagatgacgggatataccgcatcctgcagcggggactcttgggtagaagtcaggtcggcgtgggggtttttcaagagggagtgttccacaccatgtggcacgtcacaaggggcgccgtgctgatgtatcagggtaagcgtctcgaaccgagctgggcttccgtcaaaaaggacctgatttcttacgggggaggctggcgcttccagggctcgtggaacactggggaggaggtccaggtgatcgcagttgaacctggaaagaatcccaaaaacgtgcaaaccgccccaggtacgtttaagacaagcgagggcgaagtcggggcgattgctcttgatttcaaacccggaacttcaggctcccctatcgtgaatcgggagggtaagatagttgggctgtacggaaacggcgtggtcaccacaagtggcacctatgtgtctgccatcgcacaggccaaagctagccaggaagggccattgcccgagattgaggacgaagtatttagaaagaggaatctaactatcatggatctgcatcctggatccggtaagacccgacggtacctcccggccattgtgcgcgaggcaatcaaaagaaagttaaggacactggttcttgctccaacgcgggtcgtggcctcagaaatggcggaggccctgaaaggcatgcccatacgatatcaaactaccgcagtgaagtctgaacacacagggaaagagattgtcgacctcatgtgccatgctaccttcactatgagattgctgagccctgtacgcgtgccaaactacaatatgatcatcatggatgaggcccactttacagaccccgctagtattgcagccaggggatatatctccacccgtgttggcatgggtgaagccgctgcgatattcatgacggcaactcctccggggagcgtggaggcctttccccagtctaacgctgtcattcaggatgaagagaaggacatcccagaacggtcatggaactccggatacgattggattacagacttccctggcaagaccgtgtggtttgttcccagtatcaaaagcggcaacgatatagccaattgtctcagaaagaacgggaaaagggtgattcagctgtcgcgcaagaccttcgacactgagtatcagaaaacgaagaacaatgactgggattacgtcgtgaccacagacatctctgagatgggagcaaactttcgagccgatagagtaatcgacccacggaggtgccttaagcctgtgattctaaaagatggtcccgaacgcgttatcctggctggcccaatgccggtcactgtggcgtccgccgcacagcgtagagggcggattggaaggaatcagaacaaggagggcgaccagtacatatatatgggtcaacctttgaataacgatgaagaccatgctcactggacggaggccaaaatgttactggataatatcaacacccccgaggggattatcccagcactcttcgaacccgagcgcgaaaagagcgccgctatcgacggcgagtaccgactgagaggagaagcccggaaaacattcgtggagcttatgaggcgcggcgatctgcctgtctggctctcatataaggttgcgagtgaggggtttcagtactctgacagaaggtggtgcttcgatggagaacggaataaccaggtgttggaggaaaatatggacgtagagatttggactaaagaaggtgagcgtaagaagctgcgcccacgatggctagacgcaagaacctattccgatcccctggccctcagggagtttaaagagttcgctgccggccggcgcagcgtgtcaggggaccttatactggagatcggaaagttacctcagcacttgacacaaagagctcagaacgcactggataatctcgtcatgctgcataacagtgaacagggcggtaaagcctacaggcacgctatggaggaacttccggacaccattgagactatcatgctgctcgccttgattgcagtgctgaccgggggagttacgttatttttcctaagcggacggggcctggggaagacatccatcggactcctttgtgtgatgtctagctccgcgctgttgtggatggcctcagtcgagccacattggatagctgcctctatcattctggaatttttcctcatggtactgcttatccccgagcctgatcgacagagaactccccaagacaatcagctcgcatatgtggttattggtctgttgtttatgatcctgaccgtggctgccaacgaaatgggcttactagagacaaccaaaaaggatctggggataggacacgcagccgctgagaaccaccatcacgcggccatgctcgacgtcgatcttcatccagcaagtgcttggactctgtacgccgtggccacaacgattatcacccctatgatgcgccacactattgaaaatacaaccgcaaacatctcgttgaccgctatagccaatcaggcggctatcctgatgggcctcgacaagggttggcccattagcaaaatggatatcggggtcccactgcttgccttaggctgctactcccaagtgaaccctctgacactcactgcagccgttttgatgctggtggctcattatgcaattatcggaccgggcctacaggccaaggcgacgagggaggctcagaaacggaccgccgcagggataatgaagaatcccacagtagacggaattgtggccatcgatctggacccagtcgtttacgacgctaaattcgaaaagcagctcggccaaatcatgcttctgattttgtgtacttctcagatcctgctcatgcgtaccacatgggccctgtgcgagtcaataaccttagcaactggtcctcttacgacactgtgggaagggagccccggaaagttttggaacaccactattgctgtgtccatggccaatatcttcagaggcagttatctcgcgggtgccggcctagcattttctctgatgaaaagcctagggggaggcaggcgcgggaccggagctcagggcgagacactgggtgagaagtggaaacggcagctcaaccaactttcaaagtccgagttcaatacttacaaacgaagtgggattatcgaggtcgatagaagcgaagccaaggagggactgaagaggggcgaaaccacaaaacacgcagtgtctcgcggtacggctaagttgcggtggttcgtagagagaaacctggtgaaaccagagggcaaggttatagacctcgggtgtggacgtggcgggtggtcctattactgcgccggactaaagaaggtgaccgaagtcaaaggctatactaagggtgggcctggacacgaggaacccatcccgatggccacatacggctggaatctggtgaaacttcattcaggcaaagatgtctttttcattccacctgagaagtgtgacaccctgctatgcgatatcggggaaagctcgcccaacccaactattgaggagggaaggacactccgggtgctgaaaatggttgaaccctggttgcgcggtaatcagttttgtatcaagattctgaacccttacatgccgtctgtagtggagaccctcgaacagatgcagcgaaaacacggcgggatgcttgtcagaaatcccctgagtaggaactccacgcatgagatgtattgggtgagctgcggaaccggcaatatcgtttcagcggtgaacatgacatcccggatgttactgaaccgcttcactatggctcacagaaagccaacctacgagagggacgtcgatttgggtgcagggacacgacacgtggccgtagaacctgaggtggctaatctcgacataattggacaacggatcgaaaacatcaagaatgagcataaatctacttggcactatgatgaagacaacccctacaagacctgggcctatcatggcagctacgaggttaaacctagtggctccgcaagctctatggtcaatggggtggtgcgtctgctaacaaagccatgggatgtcattcccatggttacccagatagccatgactgacacgacaccttttggacagcaaagagtgttcaaagagaaggtagacacccgcactccaaaggctaaaaggggtaccgcgcagatcatggaagtgacagccaagtggctttggggctttctgtcacggaacaaaaagcccagaatttgtacgcgcgaggagttcaccaggaaagtccgaagtaatgcagctatcggggccgtgtttgttgatgagaaccagtggaactccgcaaaggaagccgtggaggacgagcggttctgggatctcgtcagaagggaacgcgagctgcacaagcagggaaaatgcgctacttgcgtgtataacatgatgggcaagcgtgagaaaaagttgggtgagtttgggaaagccaagggaagccgggcgatttggtacatgtggctgggcgcaagattcctcgaatttgaggcccttggcttcatgaatgaggaccattggttctctagggaaaactcgctgtcaggggtagagggagaaggtttacacaaactgggctacatcttgcgcgatataagcaagatcccagggggaaatatgtatgctgacgatacagccggctgggacacccgaattactgaggatgacctccaaaacgaggcaaagatcacagatattatggaacctgagcacgctctgctagccacctccatctttaaacttacataccagaataaggttgtgcgggtccagagaccagctaaaaacggtactgtgatggacgtgataagtaggcgcgatcagagagggtctggacaagtcggcacctatggcctgaacacgttcaccaatatggaagcccagctcattcggcagatggagagcgaagggatcttttccccctcagagctggagacacctaacttggcaggaagggttttagactggctggaaaagcatggtactgagcgtctccgacgcatggcgatcagtggcgacgattgtgtggtaaaaccaattgacgatagattcgccaccgctcttacagccctgaatgacatggggaagatacggaaggatatcccccagtgggaaccgtctaaaggatggaacgactggcaacaggtgcctttttgcagccaccatttccaccagctaattatgaaggatggcagggagatcgtcgtgccctgtcgcaatcaggacgaactggttggtagagcacgggtgtcccaaggggctggatggtcactcagggagactgcctgcttgggcaaaagctacgcacagatgtggcagctgatgtattttcaccgacgtgatcttagactggccgcgaacgctatttgttctgccgtcccagtggactgggtacctacctcccgcacgacatggagtatccatgcacaccatcaatggatgaccactgaggatatgctcagcgtttggaatcgggtgtggatagaagagaacccctggatggaagacaagacacacgtctcgtcctgggaggacgtgccatacttaggcaaaagggaagatcagtggtgcgggtctctgatcggattgaccgccagagctacttgggccaccaatattcaggttgcaatcaaccaggtgcgccggctgattggtaatgagaactatctcgactacatgacatcaatgaagaggttcaagaatgagagcgatcccgaaggcgctctttggtga

SEQ ID NO: 13182 - RNA, 9879 nt, synthetic construct
  misc_feature 1..9879: note = derived and/or modified CDS sequence (opt3) from DENV-1__AB189121__SS-prME
  source 1..9879: mol_type = other RNA
agcgtgaccatgctgttcatgctccttcccacggccctggcttttcacttgactacgagaggaggggaacctcatatgatcgtctccaagcaggaaaggggaaaatctttactgttcaagacctcagccggtgttaatatgtgcacattgattgccatggacctcggagaactgtgtgaagatactatgacctacaaatgcccacggataacagaaaccgaaccggacgatgtggactgttggtgcaatgcgactgaaacatgggtaacctatgggacgtgtagtcaaactggagagcaccgccgagataagcgtagcgtggctcttgcaccccatgtcggcctgggtttggaaaccagaacagagacttggatgtcctctgaaggggcatggaggcagatccagaaagtggagacctgggccctccggcaccctggatttacagttatggctctgttcctggcacatgccattggcacctcgatcacgcagaagggcattatctttatactcttaatgctggtgactccatcaatggctatgcgctgcgtcgggatcggaaatagagacttcgtggagggtcttagcggcgccacatgggtagatgttgtgttggaacacgggagttgtgtcaccactatggcgaaggacaaacccacactggatattgagctactcaagaccgaagtgacgaatcctgcagtgctgaggaaactttgcatcgaggccaagatttccaacaccacaactgactctcggtgtccaacccaaggagaagctacactggtcgaggagcaggatactaattttgtttgccgccgaaccttcgtggacagaggctggggtaacgggtgtggattgtttggcaaaggcagcctcatcacatgcgccaagttcaagtgcgtaaccaaactggaagggaagatagtgcagtacgagaatttaaaatattccgtcattgtgactgttcacacgggagatcagcatcaagtgggtaacgaaacaaccgagcacggcactaccgcaatcattacaccccaggctcctacctcagaaatccagctgactgactacggggccctcacacttgactgtagtccaaggacgggactggattttaatgagatggtcttgctaaccatgaaggagaaaagctggctggtgcataagcagtggttcctcgacctgccgcttccctggacttctggcgcgtccacatcacaagaaacctggaaccggcaggatctgttggtaacatttaaaactgcccacgcaaagaagcaggaggttgtggtcctcggtagccaagaaggggctatgcacaccgccctgacgggcgctaccgagatccagacaagtggaactaccacaattttcgccggccatttaaaatgccgtctgaagatggacaaactaactctcaagggggtgtcttatgtcatgtgtaccggatccttcaaactggaaaaggaggtggcagagacgcagcacggtacagttcttgtgcaggtaaagtacgaaggcaccgatgccccttgcaaaataccatttagctcgcaagacgagaagggggtcatccagaatggacgcttgattactgctaaccccatcgtgacagataaagaaaagcctgttaatatagaggcggagccacccttcggcgaatcttatattgtggtcggtgcaggggagaaagccctgaagctctcctggtttaagaaaggctcaagtatcggaaagatgttcgaagctaccgccagaggcgcaaggcggatggccatcctgggggacactgcttgggattttggaagcattggtggcgtgttcacctccgtagggaaacttgtgcatcagatctttggaacagcctacggcgttctgttctctggtgtcagctggacgatgaagattgggataggcatcttgctcacctggctgggattaaactcacgaagtacttccctgagcatgacatgtattgcagtgggcatggtgaccctatacctcggggtcatggttcaggcggactctggatgcgtgatcaattggaaaggccgcgagctgaagtgtggttcagggatctttgtgacaaacgaagtacacacttggaccgagcaatataagttccaggctgatagtccgaaaagacttagcgccgcaattggaaaggcctgggaggaaggcgtctgcggtataaggtccgctacgcggttggagaacatcatgtggaaacagatttctaatgaactgaaccatatcctcctggagaatgacatgaagtttacagtggttgtgggcgacgtctcggggattttagcccagggcaagaaaatgatccgccctcaacccatggaacacaaatacagctggaagtcctggggcaaggcaaaaataatcggggctgatgtgcagaacattaccttcatcattgacggaccaaatacttcagagtgtcctgataaccagagagcctggaatatctgggaggttgaagactatggctttggtatattcaccacaaacatttggctgaaacttagggatagttacactcaggtgtgcgaccaccgtttgatgtctgcggccatcaaagatagcaaggctgtacatgcagacatggggtattggattgagtccgagaagaatgagacctggaagctcgcccgggcttcattcatcgaagtcaagacatgtatatggcccaaaagccacacgctgtggtctaacggagtgctagagtccgagatgatcattccaaagatctacggcggtcccgtgagtcaacataattatcgacctggctactttacccagactgccgggccatggcacctgggaaaactcgaactggatttcgacctttgcgagggcacaaccgtcgttgtggatgaaaactgcgggaatagaggaccgagcttgaggactacaaccgtaacgggcaagactattcacgagtggtgttgccgctcttgtaccctgccccctttacggtttaaaggtgaggacgggtgctggtacggaatggaaatcagaccagtgaaggagaaggaagagaacctcgtcaaatccatggtgtcagcaggcagtggtgaagttgatagcttctcgctgggccttctgtgtatatccattatgatcgaggaggtgatgaggtctcgctggagccgaaagatgttgatgacagggaccctcgcggtctttctgctactgactatgggacagctcacatggaatgacctgatccggctttgcattatggtgggcgccaacgcttcagacatgatggggatgggaaccacatatttggccctgatggcaactttccgtatgagacccatgtttgctgttggcttactcttcaggcgcctgaccagtcgggaagtgcttctgctaacggtcggtctctccctggtagcctctgtggagttgcctaacagcctggaagagttaggggatggactcgcaatgggcatcatgatgctgaaacttctgacagactttcaaccacatcagttgtgggccaccctcctgtccctaactttcgttaagaccacattttcactgcactacgcttggaaaactatggcgatgattcttagcatagtgagtctcctgcccttgtgtctgtctaccacgtcccagaagacaacctggttaccggtcctcctgggcagccttgggtgcaagcctctgactatgttgctcatcacagaaaataaaatttggggaagaaggtcgtggccactgaacgagggtatcatggccattggcatcgtgtcaatactactgtctagtcttctcaagaatgatgtacccctggcagggcctttgatcgctggaggcatgttaattgcctgttatgtgatctccggtagctctgccgacctgagcctcgagaaagctgcagaagtctcctgggaggatgaagccgagcattcaggggcgagtcacaacattctggttgaagtgcaggacgatggaaccatgaagatcaaagacgaggagcgagatgacactcttacaatactgttgaaggctaccctactggccattagcggcgtgtaccccatgtctatcccagcaacactcttcgtctggtatttttggcagaaaaagaagcagcgctccggcgtgctgtgggatactccttcacccccagaagttgagcgggccgtacttgacaatgggatctacagaattttacagaggggactgctcggtcgtagtcaggtgggcgtcggggtgttccaagaaggagttttccataccatgtggcacgtgacacgcggcgctgtcttgatgtatcagggtaaacggctggagccgagctgggcatccgtgaagagagatctcatatcttacgggggaggctggaggtttcagggctcgtggaacaccggggaggaagtacaggtcatcgccgtggagcctggcaaaaatcccaagaacgttcaaacaactccaggtaccttcaaaacgcccgaaggcgaggtgggggcgattgctctggactttaagcctggaacaagcggctcaccaatcgtcaatcgagaaggtaagattgtggggctttacggaaacggcgttgtgactacctccggcacatatgtcagtgccatcgcacaggccaaggcttctcaggaggggcccctgcctgagatagaagacgaggtgttccggaagcgcaatttgaccatcatggatctacacccgggaagcggtaaaactagaaggtacctgccagccattgtacgggaagcaatcaagcgaaaactcagaaccttagtgctggctcccacacgcgttgtcgcctccgagatggcggaagcccttaagggcatgcctattaggtatcaaacgactgcagtgaagtcagagcataccgggaaagagatcgtggacctgatgtgccacgctacatttaccatgcgtctcttgtctccagtccgggtacccaactacaatatgataattatggatgaagcccatttcactgaccctgctagcatcgcagccagaggatatatcagtacaagggtgggcatgggtgaggccgctgcgatttttatgaccgcaacgccgcccgggtccgttgaagccttcccacagagcaacgctgtgatccaggatgaggaacgcgacatacctgagcgatcttggaactcaggatacgagtggattactgattttcccggcaagacagtctggttcgtgccatccatcaaaagtggcaacgacattgccaactgtctgagaaagaatgggaaacgggttgtgcagctcagcaggaagacctttgataccgaatatcaaaagactaaaaacaatgactgggattacgtcgtgacaaccgacatctcggagatgggagcaaacttccgcgccgaccgtgtaatagatcctagacggtgcctgaagcccgtgattcttaaagacggtccagaaagggttatcctagctggcccgatgcctgtcacagtggcgtctgccgcacagcgccgagggagaatcggacggaatcccaacaaggagggcgatcagtacgtgtatatgggtcagccactgaataacgacgaggatcacgctcattggactgaagccaaaatgttgttagacaatattaacacgcccgaggggatcattcctgcactgttcgaaccagagagggaaaagtccgccgctatagatggcgagtaccgcctcagaggagaggccaggaagacctttgtcgaactgatgcggcgtggcgaccttcccgtttggctgagctataaagtggcgtcagaggggttccaatacagtgatcgccgatggtgctttgacggagaaagaaataaccaggtactcgaggaaaatatggatgtggagatctggacaaaggagggtgaaaggaaaaagttgcggcctcgctggctggacgcaagaacttattctgatccgctagccctgagggagttcaaagaatttgctgccggccggcgatccgtcagcggggacctcattcttgagatcggaaagctgccacagcacttaacccagaaagctcaaaacgcattggacaatctggtgatgctccacaactcagaacagggcggtaaggcctacagacatgctatggaggagctgcccgatacaatcgaaacccttatgctgctcgccttgattgcagttctgactgggggcgtgacgttattctttctaagtggacgcggcctggggaagaccagcataggactcctttgtgtcatggcgtcctctgccctgttgtggatggctagcgtagagcctcactggatcgccgcatccattatcctggagttctttctcatggtgctgcttattcccgagccagacaggcagcggacacctcaggataaccaactcgcttatgttgtgatcggtctgttgttcatgatactgactgtcgccgcaaatgagatgggcttactagaaaccaccaaaaaggacctggggatcggacatgccgctgcggagaaccaccaccatgccgcaatgctcgatgtggaccttcaccccgcttcagcctggaccctgtacgccgtcgcaactacaattatcacgccaatgatgcgtcataccattgaaaatactacagctaacatctctttgaccgccatagcgaatcaggctgccattctgatgggcctcgataaaggttggcctatcagtaagatggacattggggtgccgctgcttgcattaggctgctactcgcaggttaaccccctgaccctcacagccgctgtgttgatgctggtagcacactatgccatcataggaccaggcctacaagcgaaagctactagagaggcccagaagaggacggcagccgggatcatgaagaatcctaccgtggatggaattgtcgctatcgacctggatcccgttgtgtacgacgccaaatttgaaaagcagctcggccagattatgcttctgatcttgtgtacaagccaaatactgctcatgcgcactacctgggcactgtgcgagtccattacattagctaccggtccacttactacgctgtgggaggggtctcctggaaaattctggaacacaaccatcgccgtctcaatggcgaatatctttcggggcagctatctcgccggtgcaggcctagctttctccctgatgaagagtctagggggaggccgaagagggactggagcccagggcgaaaccctgggtgagaaatggaagaggcagctcaaccagctttctaagagcgagttcaatatttacaaacgctcagggatcatagaggtggatcggtccgaagcaaaggagggactgaaaagaggcgagacaactaagcatgctgtaagtcgtggtaccgccaaattgaggtggtttgtggaacggaacctggttaagcccgagggcaaggtgattgacctcgggtgtggacgcggcgggtggagctattactgcgccggactgaaaaaggtcacagaagtgaaaggctatacgaagggtgggccgggacacgaggaaccaatccctatggcgacctacggctggaatctagtcaaacttcactctggcaaggacgtgttctttactcccccagagaaatgtgatacactgctatgcgacattggggagtcctcacccaaccctaccatcgaagagggacgaactctcagagttctgaagatggtagaaccgtggttgaggggtaatcaattctgtataaagatcctgaacccctacatgccaagcgtggtcgagacactcgagaaaatgcagcggaagcatggcgggatgcttgtgcgcaatcctctgtcgagaaactctacccacgaaatgtattgggttagttgcggaacgggcaacattgtgtccgctgtcaatatgaccagcaggatgttactgaaccgatttacaatggcacatcggaaacccacttacgagcgtgatgtggacttgggtgccgggaccagacacgtagctgtggaacctgaggttgccaatctcgatatcattggacagcgcatcgaaaacattaagaatgagcacaaatcaacatggcattatgacgaggataacccatacaagacttgggcatatcacggctcctacgaagtcaagccctctggcagcgccagttccatggtgaatggggtggtcaggctgctaaccaaaccttgggacgttatcccaatggtgacacagatagctatgaccgatactacgcccttcggacaacagcgggtatttaaggagaaagtggacacaagaaccccgaaggcgaaacgcggtactgcccagattatggaagtcaccgcaaggtggctttggggcttcctgagccgaaacaagaagcctcggatctgtacaagagaggaatttacgaggaaagtgcgctctaatgctgccatcggggcagttttcgtggatgagaaccaatggaactcagccaaggaggctgtcgaagacgagcgtttttgggacctcgtgcatcgggaaagagagctgcacaaacagggaaagtgcgccacatgcgtatataacatgatgggcaaaagggaaaagaagttgggtgagttcgggaaagcgaagggaagtcgcgcaatttggtacatgtggctgggcgcccgatttctcgagttcgaagctcttggcttcatgaatgaggatcattggttttcccgggaaaacagcctgtctggggttgagggagagggtttacacaaactgggctacatattgagagacatctcgaagattccagggggaaatatgtatgccgatgacactgcaggctgggatacaaggatcaccgaagacgatctccagaacgaggctaaaattactgacatcatggaacccgagcacgccctgctagctacatcaatattcaaacttacctaccagaacaaagtggtccgcgtgcaaagacctgccaagaatggtacagtgatggatgtcatcagccggagggaccagcgtgggtccggacaggttggcacttatggcctgaacacctttacgaatatggaagcacagctcattcgacaaatggagagtgaggggatcttctctccaagcgaactggagacccccaacttggcggaacgcgtgtttgattggttagagaagcatggaattgaaagactgaaacggatggccatctccggtgacgattgtgtagtgaagccgatagacgacaggttcgctacagccctcactgcacttaatgatatgggcaaagtccgcaaggacattcctcagtgggagccctcaaaagggtggaacgattggcagcaagtgccattttgcagtcaccatttccaccaactgatcatgaaggacggaagagagatcgttgtgccttgtcggaatcaggatgagttagtcggcagggctcgagtgtctcagggtgccgggtggagcctgcgtgagaccgcatgcctcggaaagtcctacgcccagatgtggcaattgatgtattttcacagacgcgacctgcggcttgcggctaacgccatttgttcagcagtacccgttgattgggtgccaacaagcaggactacctggtctatacatgcccaccatcagtggatgacgacagaagacatgctgtccgtctggaatagagtgtggatcgaggaaaacccctggatggaggataaaacccacgttagtagctgggaggacgtgccttacctcggcaagcgcgaagatcagtggtgcggctcgttaattgggctgactgctcgggccacatgggcaaccaatatccaagtcgctattaaccaggtgaggcgattgatcggaaatgagaactatctggactacatgacttccatgaaaagattcaagaatgaatctgacccagagggtgccctctggtga

SEQ ID NO: 13183 - RNA, 9879 nt, synthetic construct
  misc_feature 1..9879: note = derived and/or modified CDS sequence (opt3) from DENV-1__AB195673__SS-prME
  source 1..9879: mol_type = other RNA
agcgtgaccatgctgctcatgcttctgcccacggccttgactttccacttaacgacccgaggcggggagcctcatatgatcgtcggaaagcaggaaaggggtaaatccctgctatttaagacatctgctggcgttaatatgtgcactctcattgcaatggacctgggggagctttgtgatgacaccatgacatacaaatgcccacggattaccgaaactgagccggatgacgtggattgttggtgcaatgccacagaaacctgggtaacgtatggaacttgttcacaaaccggcgagcaccgccgagacaagcgtagtgtggcgctggctccccatgtcggtttggggctcgagacaaggactgaaacctggatgagctccgagggagcctggaggcagatccagaaagtggaaacatgggcactgcggcaccctggcttcaccgttattgccctgtttctcgctcatgtgatcggcacgtctattactcagaaggggatcatattcatcttactgatgcttgtcacaccatcgatggcaatgcgctgcgtgggaattggtaacagagattttgtagagggcttgtcaggggccacctgggttgacgtggtcctggagcacggaagctgtgtgactacaatggctaaggataaacccaccctagacatcgaactcctgaagacggaggtgaccaatcctgccgtccttaggaaactgtgcattgaagcgaagatcagtaacacaactaccgattcccggtgtccaacacaaggcgaggcaactttggttgaagaacaggacaccaatttcgtgtgccgccgaacatttgtagatcggggttgggggaacggatgtggcctcttcggcaaagggtctctgataacctgcgccaagtttaagtgcgtgactaaattagagggaaagattgtccagtacgaaaatctgaaatatagcgtgatcgttacggtgcacacaggtgaccagcatcaagtcggcaacgagaccactgaacacgggaccattgctacaatcacaccccaggcccctacttccgagatccagctcacagactacggagcacttacgctggattgttcaccaaggaccggcttggacttcaatgaaatggtgctactgactatgaaggagaaaagttggctcgtacataagcagtggtttctggatcttccgctgccctggacaagcggtgcttctacctcccaagagacatggaaccggcaggacttgctcgttactttcaaaaccgcccacgcgaagaagcaggaagtggtcgtgctggggtcacaagagggcgccatgcacacggcattaaccggagctacagaaattcagactagcggcaccacaactatatttgccgggcatctgaaatgccgtctaaagatggataaactcaccctgaagggaatcagttatgtcatgtgtacgggttctttcaaacttgagaaggaagtggctgagacacagcacggcaccgttttggtgcaggtaaagtacgaggggactgacgccccttgcaaaattccattctccagccaagatgaaaagggagtcacacagaatggccgcctggtgaccgcaaaccccatcgttactgacaaagagaagcctgtgaatatagaagccgagccaccctttggtgagtcgtatattgtcgtgggggctggcgaaaaagcgctcaagctgtcttggttcaagaaaggatcctcaatcggcaagatgtttgaggcaaccgccagaggggctaggcggatggccatccttggagatacagcatgggacttcggtagtattggcggggtatttacgagcgtgggaaaactggttcatcagatcttcggcaccgcctacggtgtcttgttttccggggtgtcttggactatgaagattggcataggaatcctcctgacatggttaggcctgaacagccgatcaaccagtctatccatgacatgtattgctgtggggctcatcactctgtaccttggagtcatggttcaggccgatagcggctgcgtgatcaattggaaaggtcgcgaattgaagtgtgggtctggaattttcgtgaccaacgaggtacacacgtggacagaacaatataagtttcaggcagactcaccgaaaagactgagtgcggctataggcaaggcctgggaggagggtgtctgcggcatcaggagcgcaacccggctcgaaaacattatgtggaaacagatctccaatgagctgaaccatattttactggaaaatgacatgaagttcactgtggttgtgggggatgtctctggaatccttgcccagggcaaaaagtcgatacgccctcaacccatggagcacaaatacagctggaagtcctgggggaaggctaaaatcattggagccgacgtgcagaacaccacatttatcattgatggcccaaatactcctgaatgtcccgacgatcagagagcatggaacatctgggaggttgaggactatggtttcgggatatttaccacaaatatttggttgaagctcagggattcatacacacaggtgtgcgaccaccgtctgatgagtgctgccatcaaagattctaaggcggtacatgccgacatgggatattggattgaaagcgagaaaaacgaaacctggaagctagctcgggcatccttcatcgaggtcaagacttgtatatggccaaaatcacacacactgtggagcaatggcgtgctcgaatctgagatgatcattcccaagatctacggtggccctatttcccaacataactatcgaccagggtacttcacccagactgccggaccgtggcacctgggcaaacttgagttggattttgacctgtgcgaagggacaaccgtggtcgttgatgagcactgcggaaatagaggccccagtttaaggacgactaccgtgacaggtaagatcatacatgaatggtgttgccgcagctgtaccctccctccactgcggttcaaaggggaggacggatgctggtacggcatggagattagacccgtaaaggaaaaggaggaaaaccttgtgaaatctatggtctccgctggttcaggcgaggtggacagttttagcctggggttgctctgtatctcgatcatgattgaagaggttatgaggtcccgctggtctcgaaagatgctgatgactggaacactagccgtgttcctgctcctgaccatgggccagcttacatggaatgatttgatccggctgtgcattatggtcggggcaaacgcgagcgacaatatgggaatgggcactacctatttagccctcatggctacgtttcgtatgagacctatgttcgccgtgggtctgctttttaggcgcctgacatcacgggaggttctactcctgaccgtggggttgagtctggtcgcatccgtagaattaccaaactctctcgaggaactgggagatggccttgctatgggcataatgatcctgaaattgctcactgacttccaaagccaccagctgtgggccaccctactgtcccttacatttgtgaagactaccttctcactccattacgcatggaaaacgatggccatgattctgagcatcgttagtttgtttcccctgtgtttatctacaacctcccagaagactacatggctcccggtgctgcttgggagcctgggatgcaagcctttgaccatgttcctcattactgagaacaaaatctggggtagaaagtcgtggccactgaatgaaggcataatggctgtcgggatcgtgtcaattctactgtctagtcttctcaaaaacgatgtacccctggcgggacctttgatcgccggcggtatgttaattgcatgttatgtgatctccgggagctctgctgacctgagcctcgagaaggccgccgaggtctcctgggaagaggaagctgagcactcaggagcaagtcataatatactggttgaaattcaggatgacggcacaatgaaaatcaaggatgaggagagggacgataccatcacgattcttctgaaagccactttgctagcgataagcggcgtgtaccccatgtctatcccagctaccctgtttgtgtggtatttctggcaaaagaagaaacagcgatccggggtcctctgggacacaccttcacccccagaagtggagcgcgccgttctggatgacggaatttaccggatccttcagagaggtttactgggcaggagtcaggtaggggtgggagtcttccaagaaggcgtgtttcacaccatgtggcacgttacacgtggtgcagtgctcatgtatcaggggaagcgcttggagccgagctgggcctccgtcaaaaaggacctgatttcttacggaggcggctggcggttccaggggtcgtggaacactggagaggaagtgcaggtaatcgctgtcgagcctggtaaaaatcccaagaacgtgcaaaccgcaccaggcacgtttaagacaagcgaaggggaggttggagccatagcgctcgatttcaaacccggcacttcaggttcccctatcgtgaatagagaagggaagattgtcggactgtacggcaacggcgtggttaccacaagtgggacctatgtgtctgctatcgcccaggcaaaagccagccaggagggaccacttcccgagattgaagacgaggtctttaggaagcgaaatctgactatcatggatttgcatcctggttccggcaaaacccggcgctacctaccggctatagtgagagaagccattaagaggaagctgcggacactcgtattagcaccaacgcgagtggttgcttcagagatggccgaagcgctgaaagggatgcccatcagatatcaaactaccgccgtcaagtctgagcacacaggacgcgagatcgtggaccttatgtgccatgcaaccttcactatgaggctgctcagccctgtgcgtgtcccaaactacaatatgattatcatggatgaagctcactttacagaccccgccagtatagctgcacggggctatatttccaccagagtaggtatgggggaggccgccgctatcttcatgacggcgactcctccgggaagcgtggaagcatttccccagtctaacgccgttattcaggatgaggaaaaagacatcccagagaggtcatggaactccggctacgattggataacagacttccctggcaagaccgtgtggtttgtccccagtattaaaagcgggaacgatatcgctaattgtttgcgcaagaacggaaagcgagtgatccagctgtcgagaaaaaccttcgacactgagtatcaaaagaccaagaataatgactgggattacgttgtgaccacagacatttctgaaatgggtgccaacttccgggcagatagggtcatcgacccacgccgttgcctcaagcctgtgattctgaaagatggccccgagagagtaatacttgccgggccaatgccggtgactgttgcttccgcggcccagcggaggggacgcatcggccgaaatcagaacaaggaaggtgaccagtacatttatatggggcaacctctaaataacgatgaggaccatgcacactggacggaggctaagatgctgttggataatatcaacacccccgaaggcatcattccagccttatttgagcccgaaagagagaaaagcgcagccatagacggagaataccggctgaggggcgaggctcgcaagacattcgtcgagctcatgagaagaggggatctgcctgtgtggctttcatataaagtggccagtgaaggatttcagtactctgaccggcgttggtgcttcgatggtgagcgcaataaccaggtcctggaagagaatatggacgttgaaatctggactaaggagggcgagaggaaaaagctcagaccaagatggttggacgcgcggacctattccgatcccctggcactacgcgaatttaaagagttcgccgctgggagaaggagcgtgtcaggagacctgattctcgaaatcggcaaacttcctcagcacctgacacaacgggcccagaacgctttagataatttggtaatgctgcataacagtgagcagggtgggaaggcataccgacacgccatggaggaactcccggacaccattgagactctgatgcttctggctctcatcgccgtgttgacgggcggagtcaccctgtttttcttaagcggcagagggctaggaaaaacatccataggtctgctctgtgtgatgtctagctccgcacttctgtggatggcgtcagttgaaccacattggatcgccgcttctattatcttggagtttttcctgatggtgctcctgattcccgaacctgatcgccagaggactccccaagacaatcagcttgcctatgtcgtaatcggcctcctgtttatgatattgaccgtggcagctaacgagatggggctgttagagacaaccaagaaagatctaggaattggccacgccgcagccgaaaaccaccatcacgctgcgatgctggacgttgatctccatccagccagtgcatggactctttacgctgtggccacaacgatcattacccctatgatgcggcacactatcgagaatacaaccgccaacatatcgctgaccgcaatcgctaatcaggccgcgattttgatgggtctggacaaggggtggcccatcagcaaaatggatattggcgtcccactcctggctcttggatgctactcccaagtgaaccctttaacactgactgccgcagtcctcatgttggtggcccattatgctatcataggcccggggctgcaggcaaaggccacgcgtgaagcgcagaagagaaccgctgccggaattatgaaaaatcccacagttgacggcatcgtggcaatcgatctagacccagtagtgtacgacgccaagttcgagaaacagctgggtcaaattatgctccttatcctgtgtacttctcagatattgctgatgaggaccacatgggctctctgcgaatcaattaccctggccactgggcctttaacgacactttgggagggaagccccggcaagttttggaacaccactatcgcagtctccatggctaatattttccgcggtagttatctggccggcgcggggctcgccttctctctaatgaaaagcctgggaggcgggcggcgaggaaccggcgcacagggtgagacattgggggaaaagtggaagagacagctgaaccaactctcaaaatccgagtttaatatctacaagaggagtggaatagttgaagtggatcgcagcgaggctaaagaaggccttaagcggggtgagactatcaaacacgccgtctctagaggcaccgcaaagctgcgttggttcgtggagaggaacttggtaaagccagaagggaaagtgattgacctgggatgtggcagaggcgggtggtcctattactgcgctgggctcaagaaagttacagaggtgaagggttatacgaaagggggacctggccacgaggaacccatcccgatggccacctacggctggaatttagtcaagctgtactcagggaaagatgtgtttttcattccacctgaaaagtgtgacactcttctgtgcgatatcggagagagctcgcccaacccaacaattgaggaaggtcgcaccctacgagtcctcaagatggtggagccctggctgagaggcaatcagttttgtatcaaaatattgaacccttatatgccgtctgttgtagaaactctggagcagatgcagaggaagcatgggggaatgctcgtgcggaatccccttagtcgcaactccacacacgagatgtactgggtcagctgcggcaccggtaatattgtgtcagccgttaacatgacgtccagaatgctgttaaacaggttcaccatggcgcatcgaaaaccaacatatgaacgggacgtggatctgggggctggaactcgtcacgtcgcagtggagcctgaagtagccaatttggacatcatcggccaaagaattgagaacataaagaatgaacacaaatctacctggcattacgatgaggacaacccctataagacatgggcttaccacggcagctatgaggtgaagcctagtgggtccgccagctctatggttaatggagtcgtgcgcctcctgactaaaccatgggatgtgatccccatggtcacccagattgcaatgacagacaccactccttttggtcagcaaagggttttcaaggaaaaagtggacacgcggacaccaaaggccaaaagaggcaccgctcagatcatggaggtaactgcgaagtggctatgggggtttctttcacgcaacaagaaacccaggatttgtacccgagaagagttcacacggaaggtgagaagtaatgccgcaatcggagctgtctttgtggatgaaaaccagtggaactccgccaaagaggcagttgaggacgaaaggttctgggatctggtgcgccgtgagcgggaactccataagcagggcaaatgcgccacgtgcgtctacaacatgatgggtaagagagagaagaaactgggggaatttggaaaggctaaaggcagcagggccatatggtacatgtggttgggcgcgcgcttcctggagttcgaggcactcgggtttatgaatgaagaccactggttctctcgagagaactcgctttcaggagtggaaggtgagggcctgcataagttagggtatatcctgcgggatattagcaaaatcccgggaggcaatatgtacgccgacgataccgctggttgggacactagaattacagaggatgacttgcaaaacgaagccaagatcaccgatataatggagcctgaacacgcactcctggctacttccatttttaaactaacatatcagaataaggtagttagggtgcagcgcccagccaagaacgggaccgtcatggacgtgatcagtagacgggatcagaggggatctggccaagtgggcacatacgggcttaacactttcaccaatatgggagctcagctgatccgtcagatggagagcgaaggtatattttccccctcagagctcgagacgcctaacctggccggccgagtcttggactggttagaaaaacacgggatagagcgcctgagacggatggcaatcagtggagacgattgtgttgtgaagccaattgacgataggttcgcgaccgccctcacagctcttaatgacatgggcaaagtacgcaaggatatcccccagtgggaaccgtctaaaggttggaacgactggcaacaggtgcctttttgcagccatcacttccatcagctgattatgaaggatgggagagagatcgtcgtgccctgtcggaatcaggacgagctagttggaagggcccgagtgtcccaaggcgcaggctggtcactgcgtgagactgcttgcctcggaaagagctatgcccagatgtggcagttgatgtactttcacagacgcgatctgcggcttgcagccaacgcgatatgttctgctgtcccagtggactgggtacctacctccaggacaacttggagtatccacgcccatcaccaatggatgaccacggaggatatgctgagcgtttggaatagagtgtggattgaagagaacccctggatggaagacaaaacacatgtctcgtcctgggaggacgtgccatatctcggaaagcgcgaagatcagtggtgcggttctttaatcggcctgaccgcacgggccacttgggctacaaatattcaggttgccatcaaccaggtgaggcgattgattgggaatgagaactacctggactacatgacctcaatgaaaagattcaagaatgagagcgatcccgaaggagcactctggtga

SEQ ID NO: 13184 - RNA, 9879 nt, synthetic construct
  misc_feature 1..9879: note = derived and/or modified CDS sequence (opt3) from DENV-1__AB204803__SS-prME
  source 1..9879: mol_type = other RNA
agcgtgaccatgctgctcatgcttctgcccactgtcttgactttccacttaacgaccagaggcggggaacctcatatgatagtttccaagcaggaaagaggaaaatctctgctatttaagacctcagccggtgtgaacatgtgcactctcattgctatggacctgggcgaactttgtgaagataccatgacctacaaatgcccacggataaccgaaactgaaccggacgatgtagactgttggtgcaatgcaacagaaacctgggtgacgtatgggacttgtagtcagaccggagagcaccgccgagataagcgtagcgtcgccctggcgccccatgtgggcttgggtctcgaaacacggactgagacctggatgtcctctgaaggggcttggaaacagatccagaaggttgagacatgggccctgaggcaccctggattcaccgtgattgcactgtttctcgcccatgctatcggcacgtcgattactcagaagggcatcatattcatcttactgatgcttgtcacaccatcaatggcaatgcggtgcgtggggattggaaaccgcgactttgtagagggtttgagcggcgccacctgggttgatgtggtcctggaacacgggagttgtgtgactacaatggctaaagacaagcccaccctagatatcgagctcctgaaaacggaagtgaccaatcctgccgtccttagaaagctgtgcattgaggcgaaaatctccaacacaactaccgactctaggtgtccaacacaaggagaagcaactttggttgaggagcaggataccaatttcgtgtgccggcgcacatttgtagaccgaggctggggtaacgggtgtggactcttcggcaagggcagcctgataacctgcgtgaagtttaaatgcgtcactaagttagaagggaaaattgtgcagtacgagaatctgaagtattccgttatcgtgacggtccacacaggagatcagcatcaagtgggtaacgaaaccactgagcacggcaccattgccacaatcacaccccaggctcctacttcagaaatccagctcacagactacggggcccttacgctggactgtagtccaagaaccggattggatttcaatgagatggtactactgactatgaaagaaaagagctggctcgttcataaacagtggtttctggaccttccgctgccctggacatctggcgcatccacctcacaagaaacatggaacaggcaggatttgctcgtgactttcaagaccgctcacgccaagaaacaggaggtcgtggtcctgggtagccaagaaggggcgatgcacacggccttaaccggcgcaacagagattcagacaagtggaaccacaactatatttgctggccatctgaagtgccggctaaaaatggacaagctcaccctgaaagggacgtcttatgtgatgtgtacaggacctttcaaacttgaaaaggaggttgccgagacccagcacggtactgtgttggtacaggtcaaatacgaaggcacagatgctccatgcaagatccccttctccagccaagacgagaaaggggtgacccagaatggacgtctgattactgccaaccctatcgttaccgataaggaaaaaccaataaatattgaggcagagcccccgtttggcgaatcgtatatcgtggtcggtgtgggggagaaggccctcaagctgtcttggttcaaaaagggctcctcaatcggaaaaatgtttgaagctacagcgcgcggcgcaagaaggatggccattcttggggacacggcttgggatttcggaagtatcggtggcgtatttaccagcatggggaagctggtgcatcagattttcggaactgcctacggcgttttgttttccggtgtctcttggacaatgaaaatagggatcggcattctcctgacctggttaggactgaacagccggtcaacaagtctatccatgacttgtatcgcagtgggcatggtgaccctctacctgggggtcatggttcaggccgacagcggatgcgtgatcaattggaagggccgagagcttaagtgtggttctgggattttcgtgacgaacgaagtacacacatggaccgagcaatataaatttcaggctgattcacctaagcgcttgagtgccgcaataggaaaagcgtgggaggaaggcgtctgcggtatcagaagcgctactaggctggagaacattatgtggaagcagatctccaatgaactcaaccatattctgttagagaatgacatgaaattcaccgtggttgtgggcgacgtctctgggatcctggcccagggaaagaaaatgatacggccccaaccaatggaacacaagtactcgtggaaaagctggggcaaagcaaagatcattggggccgatgtgcagaacacaacttttatcattgacggacctaatacccccgagtgttccgatgaccagcgcgcttggaacatctgggaggttgaagattatggcttcggtatatttacaacgaatatttggcttaaattgagagactcatacacccaggtgtgcgatcacaggctcatgagtgccgcaatcaaggactctcgtgctgtacatgccgatatggggtattggattgagagcgagaagaatgagacttggaagctggcgcgggcctccttcatcgaagtcaagacatgtatatggccaaaatcacacaccctatggagcaatggagtgctggagtctgagatgatcattcccaagatctacggcggtcctatttcccaacataactatcgaccaggctacttcactcagacagctgggccgtggcacctcggaaaactggaacttgactttgatttgtgcgagggcaccacggtggtcgttgacgaacagtgcgggaatagaggacccagtctgaggactaccacagtgaccggcaagatcatacacgagtggtgttgccgcagctgtactttacctccactccggttcaaaggtgaggatgggtgctggtacggaatggaaattagacccgtaaaggagaaggaagagaacctggtgaaatctatggtctccgcaggctcaggtgaagtggacagttttagccttggcctgttgtgtatctcgatcatgattgaggaggttatgaggtcccgctggtctcgaaagatgctcatgacagggaccctggccgtgttcctactgctcacaatgggacaactgacttggaatgaccttatccggttgtgcattatggtcggcgctaacgccagcgataaaatggggatgggaaccacgtatctggcattaatggcgacatttcgtatgagacctatgttcgccgtgggcctcctgtttaggggtcttacctcacgcgaagttctgctactcactgtggggctgagtttggtcgcttccgtagagctgccaaattctttagaggagctcggagacggcctggccatgggcataatgatgcttaagctgttgaccgatttccagagccatcagctctgggcaacactgctatccctgacttttgtgaaaaccacgttctcacttcactacgcttggaagacaatggccatgaccctcagcatcgttagtctgtttcccttgtgtctgtctactacatcccagaagaccacttggttaccggtgctcctggggagccttggatgcaaacctctgacaatgttcttgattaccgaaaacaagatctggggtcggaaatcgtggccactcaacgagggcattatggcagtcgggatcgtgtcaatactgctatctagtctgcttaagaatgacgtacccctcgccggacctctgatcgctggcggtatgttgattgcgtgttatgtgatctccgggagctctgccgatttaagcctggagaaagcagctgaagtctcctgggaggaagaggccgaacattcaggagccagtcacaacattctcgttgaggtgcaagacgatggcacgatgaagatcaaagacgaggaaagagatgacactataaccattctgcttaaggctacactgttggcaatcagcggcgtgtaccccatgtctatcccagccaccctatttgtctggtatttctggcagaagaaaaagcagaggtccggggtgctgtgggatacaccttcacccccagaggttgaacgagcggtactcgacgatggaatttaccgcatactgcagcggggtcttttaggcagaagtcaagtgggggtcggagtgttccaggagggcgtttttcatactatgtggcacgtgaccaggggtgctgtcctgatgtatcaggggaaacgtctcgagccgagctgggcctccgtgaagaaagacttgatctcttacggaggcggctggcgcttccaggggtcgtggaatacgggagaagaggtacaagtcattgcagtggaacctggtaagaaccccaagaatgttcagacagccccaggcacttttaaaaccagcgagggggaagtgggagctatcgcactggacttcaagcccggcacatcaggttcccctattgtcaaccgggaggggaaaatcgtgggactctacggcaatggcgttgtgaccacaagtgggacctatgtctctgccatagcgcaggctaaggccagccaagagggaccactgcccgaaatcgaggatgaagtgtttagaaaaaggaaccttacaattatggacctgcaccctggttccggcaagacgcgacggtacttgccggcaatcgtacgcgaggccattaagagaaaactaaggactctggtgctcgctccaacccgggttgtcgcctcagaaatggcagaggctttaaaggggatgcccatccgatatcagacaaccgccgtgaaatctgagcatactggaaaggaaatagtggatctgatgtgccacgcgacattcaccatgagacttctgagccctgtccgcgtaccaaattacaacatgattatcatggacgaggcccattttacggatcccgcaagtatcgctgccaggggctatatttccactcgtgtgggtatgggggaagctgcagccatcttcatgacagccacccctccgggaagcgttgaggcttttccccagtctaatgcggtgatacaggacgaagagaaagatattccagagcggtcatggaactccggctacgactggatcaccgatttccctggcaagactgtctggtttgtgcccagtattaagagcgggaatgacatcgcaaactgtctcaggaagaatggaaagagggttatacaattgtcgcgcaaaacattcgataccgaatatcagaagactaagaacaacgactgggactacgtggtcactacggatatttctgagatgggtgccaatttccgagctgacagagtgatcgatccacggaggtgcctgaagcctgtaatcctcaaggacggccccgaacgcgtgattctggccgggccaatgccggttaccgtcgcatccgccgctcagcgtagaggacggatcggcaggaaccagaataaagagggtgatcaatacatttatatggggcagcctcttaacaatgacgaggatcacgcgcattggacagaagccaagatgctactggacaacataaatactcccgagggcatcattccagcattgtttgaacccgagcgcgaaaagagcgctgccatcgatggagagtaccgattaagaggcgaggcacggaagaccttcgtggaactgatgaggcgcggggacctccctgtgtggctgtcatataaagtcgccagtgagggatttcagtactctgatagaaggtggtgcttcgacggtgaacggaacaatcaggttcttgaggaaaacatggatgtggagatctggacaaaggagggcgaacgtaaaaagctgcgcccacgatggctcgacgctagaacctattccgaccccttggccctgagggagtttaaggagttcgcggcagggcggcgcagcgtatcaggagatctaattctggagataggcaaactccctcaacaccttactcagaaggcccagacggctctggacaatttagtgatgttgcacaacagtgaacagggtgggaaagcctacagacatgctatggaggagctgccggataccatcgaaacactcatgctgcttgcactgattgccgtcctcactggcggagtgaccttgtttttcctgagcggcaaggggttaggaaaaacatccatcggtctactgtgtgttatgtctagctccgctctcctttggatggcctcagtggagccacactggattgcagcgtctatcatactggaatttttcttgatggtcctgctcatccccgagcctgacaggcaacggacaccccaggataatcagctggcctatgtagtgattggccttctctttatgatcctgactgttgctgccaacgagatggggttgctggaaacaacgaagaaggacttaggaattggccatgcagctgccgagaatcaccaccatgcagccatgctagatgtggacctgcacccagctagtgcgtggaccctctacgccgtcgcaactacaatcataacccctatgatgcgacataccattgaaaacacaactgctaacatctcgcttacggccattgccaatcaagcagctatcctgatgggtttggataaagggtggcccataagcaagatggacatcggcgtgccactgctcgccctgggatgctactcccaggtcaaccctcttaccttaacagcggctgtgctgatgctcgttgcccactatgcaattatcggcccggggttgcaggccaaagctactagagaggcacagaagcgcaccgccgcgggaattatgaaaaatcccacagtggatggcatcgtagctatagacctggatccagtggtctacgacgccaagttcgaaaagcaactaggtcagattatgctgctcatcctttgtacctctcagatcctgttgatgaggactacgtgggcactgtgcgagtcaattacactcgccaccgggcctctgactaccttatgggagggaagccccggcaaattttggaacacaactatcgctgtttccatggccaatatattccggggtagttatcttgcaggcgctgggctggccttctctctcatgaaaagcctaggaggcgggcgtagaggaaccggcgcgcagggtgaaacactgggggagaaatggaagaggcaattgaaccagctgtcaaaatccgaatttaatacgtacaagcgcagtggaattatggaggtggaccggagcgaagccaaggagggcctcaaacgaggtgagaccactaagcatgcagtctctagaggcacagctaaacttaggtggttcgtggaacgcaacctggtaaagccagaggggaaagtgatcgatttgggatgtggcagagggggatggtcctattactgcgccggcctgaagaaagttaccgaagtgaagggttatactaaagggggacctggccacgaggaacccattccgatggcaacatacggctggaatctcgtcaaattacactcagggaaggacgtgtttttcatcccacctgagaaatgtgataccctgctttgcgacataggagagagctcgcccaacccaacgatcgaagagggtagaaccctgcgtgtcctaaagatggtggaaccctggctcaggggcaatcagttttgtattaaaatcctgaacccttacatgccgtctgttgtagagacattggagcagatgcaacggaagcatgggggaatgctggtgcgcaatcccctcagtcgaaactccactcacgaaatgtattgggtcagctgcggcaccggtaatattgtgtcagctgttaacatgacatccagaatgcttctgaataggttcactatggcccatcggaagccaacctacgagcgcgatgtggacttaggggccggaacaagacacgtcgcggtggaacctgaggtagctaacctggatatcattggccagaggatcgaaaacatcaaaaatgagcacaagtctacctggcattatgacgaggataacccctacaaaacttgggcatatcacggcagctacgaagtgcgacctagtgggtccgccagctctatggttaatggagtcgtgcggttgctcacgaagccatgggacgtgattcccatggtcacacagatcgctatgaccgatactaccccttttggtcaacagcgtgttttcaaagagaaggtggacacaagaacgccaaaggccaaacgcggcaccgcacagatcatggaagtaactgccaagtggctgtgggggtttctatcaaggaacaaaaagccccggatttgtacaagagaggagttcacccgcaaagtgaggagtaatgctgcgataggagccgtctttgtggacgagaaccagtggaactccgcaaaggaggctgttgaagatgagcgattctgggaccttgtgcatcgggaaagagagctgcacaagcaaggcaaatgcgccacttgcgtctataacatgatgggtaagagggagaaaaagctcggggagtttggaaaagcaaagggcagccgcgccatctggtacatgtggctgggcgctcgtttcttggagttcgaagccctggggtttatgaatgaggatcattggttctctcgggaaaactcgctctcaggagtggagggtgagggccttcacaaactggggtacattttaagagacatcagcaagattccgggaggcaatatgtatgcggatgacacagcaggttgggataccaggatcacagaagacgatctgcagaacgaggccaagataactgacatcatggaacctgagcacgctttgctcgccacctccatttttaaactgacgtaccagaataaggtagttcgcgtgcagcgaccagcaaaaagtgggaccgtcatggatgtgatctctcggagagaccaaaggggaagcggccaggtgggcacatatgggctaaacactttcaccaatatggaagctcagcttattcgccagatggagtccgagggaatcttttcacccagtgaactggagacacctaacctcgccggtagagtcctggattggttggaaaagcatggcatagagcggttaaaaaggatggctatttctggggacgactgtgttgtgaagccaatcgatgaccgtttcgccactgcactgaccgcgctcaacgatatgggaaaggtacgaaaagacatcccccaatgggaaccgagcaagggctggaatgattggcaacaggtgcctttttgctcccaccatttccaccagcttattatgaaagacggtcgcgagatagtcgtgccctgtagatcacaagatgagctggttgggcgggccagggtgagccagggagctggctggtctctacgcgaaacggcctgcctgggcaagtcctacgcacagatgtggcaactcatgtattttcacagacgggacttgaggctggctgccaacgcaatctgtagtgccgtcccagtggattgggtacctacaagccgaaccacttggtcgattcatgcgcaccatcagtggatgacaaccgaggacatgctttccgtttggaatcgtgtgtggatcgaagagaacccctggatggaagataaaactcacgtctcttcatgggaggacgtgccatacctggggaagagagaggaccagtggtgcggaagcctcattggtttaaccgctcgcgccacatgggcaacgaatatccaggttgccataaaccaagtgcggaggctgatcggcaatgaaaactatttggattacatgaccagtatgaagagattcaaaaatgagtccgaccccgaaggggctctgtggtga

SEQ ID NO: 13185 - RNA, 9879 nt, synthetic construct
  misc_feature 1..9879: note = derived and/or modified CDS sequence (opt3) from DENV-1__LC016760__SS-prME
  source 1..9879: mol_type = other RNA
agcgtgaccatgctgctcatgcttatgcccacagcactggctttccacttgactacgagaggaggggaacctcatatgatcgtctccaagcaggaaaggggaaaatctttactgtttaagacctcagccggtgttaatatgtgcacactaattgccatggacctcggcgagctgtgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaactactcaagacagaggtgaccaaccctgccgtgctgaggaaactttgcattgaagctaagatctctaatacgaccacagatagccggtgtccaactcaaggagaggccaccctggtcgaagaacaggacgcaaacttcgtttgccgccgaacatttgtggatagaggctggggtaatgggtgtggattgttcggcaaaggctccctcataacttgcgctaagtttaagtgcgtaaccaaactggaggggaagattgtgcagtacgaaaacttaaaatattcagtcatcgtgacagttcacaccggagaccagcatcaagtgggtaatgagagtactgaacacggcacgacagccaccattactccccaggcgcctaccacagagatccagctgaccgactacggggccctcactcttgattgtagcccaaggacaggactggacttcaacgaaatggtcttgctaacgatgaaggagaaatcttggctggtgcataagcagtggtttctcgatctgccgcttccctggacctccggcgcatcaactagccaagagacatggaatcggcaggacctgttggtaaccttcaaaacagctcacgccaagaagcaggaagttgtggtcctcggtagtcaagagggggctatgcacactgccctgaccggcgcaacggaaatccagacctctggaacaactaccatttttgccggccatttaaaatgccgtctgaagatggataaactaacactcaaggggatgtcctatgtgatgtgtactggtagcttcaaactggagaaggaagtcgctgagacccagcacggaacggtgcttgttcagataaagtacgagggcacagacgcgccttgcaaaatcccattctcgacccaagatgaaaagggggtgactcagaacggacgcttgattacagcaaatcccatcgtaaccgacaaagagaagcctgtcaacatagaagccgagccaccctttggcgagtcttatattgtgatcggtgctggggaaaaagccctgaagctctcctggttcaagaaaggctcaagtatcggaaagatgtttgaggcaactgccagaggcgctaggcggatggccattctgggggataccgcatgggacttcggaagcatcggtggcgtttttacatccgtggggaaacttgtccatcagattttcggaacggcgtacggcgtgctgttttctggtgtaagctggaccatgaagatagggatcggcgtgttgctcacttggctgggattaaattcacgaagtacatccctgagcatgacctgtattgctgttggcctagtcacactctacctgggggtgatggtgcaggccgattctggatgcgtcatcaactggaaaggccgcgaacttaagtgtggttcagggatcttcgttactaatgaggtgcacacctggacggaacaatataagtttcaggcagacagtccgaaaagattgagcgccgctattggaaaggcctgggaggagggcgtgtgcggtataaggtccgcaacacggctggaaaacatcatgtggaaacagatttctaacgagctcaatcatatcctgttagaaaacgacatgaagttcaccgtagtcgtgggcgatgttgctgggattctggcccagggcaagaagatgatccgccctcaacccatggagcacaaatactcgtggaaaagctggggcaaggcgaagataatcggggccgacgtgcagaatactacctttattatcgatggaccaaacacacctgaatgtcccgacgatcagagagcttggaatatttgggaggtcgaggactatggcttcggtatctttactaccaacatatggcttaagttgagggattcctacacacaggtgtgcgaccaccgtctcatgtcagcagccattaaagatagtaaggctgttcatgccgacatggggtattggatcgaatctgagaaaaatgaaacgtggaagctggcacgggcgagcttcattgaggtgaagacctgtatctggccaaaatcccacactctatggtcaaacggagtactggaaagcgagatgataatccccaagatttacggcggtcctatctctcaacataattatcgaccaggctacttcacacagaccgccgggccgtggcacctcggaaaactggagcttgattttgacttgtgcgaaggcactacagtcgtggtggatgagcactgcgggaacagaggaccctccctgaggaccacgactgtcaccggcaagattatccatgaatggtgttgccgcagttgtacattacctccactccggtacagaggtgaggacgggtgctggtatggaatggagataaggcccgttaaagaaaaggaggaaaatctggtgaagtccatggtatctgctggctccggtgaggtggactcattcagtcttggcctgttgtgtattagcatcatgatcgaagaggtcatgcgctcgcgatggtcccggaaaatgctcatgaccgggactctggccgtgtttttcctactgattatgggacagctcacatggaacgatctgatccgtctttgcattatggttggcgcaaatgcttctgacagaatggggatgggaaccacatacttggccctgatggcaacttttaagatgaggcctatgttcgccgtgggcttactctttcgccggctgaccagcagagaggtccttctgctaacgataggtctctcactggtggctagtgttgaattgccaaactccctggaggaattaggggatggactcgcgatgggcatcatgattctgaaacttctgacagacttccaatctcaccagttgtgggccaccctcctgagcctaacttttatcaagaccacattctccctgcattatgcatggaaaactattgctatggtgctttcaatcgtcagcctctttcccctgtgtttgagtaccacgtctcagaagacaacctggctgccggtattactcggctccctggggtgcaagcctcttactatgttcctgatagccgagaataaaatctggggaagaaagagctggccattgaacgaaggtattatggccgtgggcatcgtttcgattctcctgtcatctctactgaaaaacgatgtgccccttgctgggcctctcatcgcaggaggcatgctgatagcctgttacgtcattagtggttccagcgcggacttgtctttagagaaggctgccgaggtgagctgggaagaggaagcagagcactccggggcctcacataatatcctggtagaagtgcaggatgacggaacaatgaaaatcaaggatgaggagcgagacgataccctcactattctgcttaaagctacactgttggcagtcagtggcgtttatcccctaagcataccagccaccctgtttgtgtggtacttctggcaaaagaagaaacagcgctctggcgtgctctgggacacgccttcacccccagaagtcgagcgggcggtgctggatgacgggatctatagaattatgcagaggggacttttaggtcgtagccaggttggcgtaggggtgttccaagaaaacgtctttcacactatgtggcacgtgacccgcggagctgttctgatgtaccagggcaagcggctcgagccgagttgggccagcgtgaaaaaggacttgatctcctacggtgggggatggagactgcagggctcttggaatacaggcgaggaagtccaggtgattgcagtagagcctgggaaaaaccccaagaatgtccaaaccgccccaggaacattcaagactcccgaaggtgaggtgggcgctatcgccctcgattttaaacctgggacctcgggaagcccaatagttaacagggaaggcaagatcgtgggtctgtatgggaatggagtcgtgacgacatcaggcacttacgtttccgcaattgctcaggccaaagcgagtcaggagggcccccttcctgagatcgaagacgaggtgttccgaaagcggaacctgaccattatggatttgcatccggggtctggaaaaacacgcagatatctaccagccatcgtcagggaagcaataaagcggaagctgcgaaccctcattttagctcccactagagtggtagccagcgagatggctgaagcactgaaaggtatgcctatccgctaccaaaccacagccgtgaagtccgagcacacgggcaaagagatcgttgaccttatgtgccatgccacttttaccatgaggctgctctcaccagtccgtgtgcccaattataacatgattatcatggatgaagctcacttcacagacccttctagcatagcggcacgggggtacattagtaccagagtgggaatgggcgaggccgctgccatctttatgactgcaacaccgcccggttccgtcgaagccttcccacagagcaatgctgtaattcaggatgaggaaagggacatccctgagcgctcttggaactcagggtatgagtggataaccgattttcccggaaagacggtgtggttcgttccatccattaaaagtggcaatgacatcgcgaactgtttgcgaaagaatggcaagagagtgatccagctgagccggaaaacttttgatacagaataccaaaagaccaaaaacaacgactgggactacgtcgtgaccactgatatttcggagatgggggccaatttcagggcagaccgcgttatcgatcctcgtagatgcctcaagcccgtgattctgaaagacggaccagaacgggtcatacttgctggtccgatgcctgtgacagtagcctctgcagcccagaggcgcggccgaatcgggagaaaccataataaggagggagatcagtatatttacatgggccagcccctaaacaatgacgaggatcacgctcactggaccgaagccaagatgctgttggacaacatcaatacaccagagggtatcattcccgcgttattcgaacctgagcgggaaaaatccgcagccatagatggggagtataggctgcgcggcgaggctagaaagacttttgtggaactcatgaggcggggagacctgccagtttggcttagctacaaagtcgcctcagagggcttccaatatagtgatcgtcgctggtgctttgacggggaacgaaacaatcaggtgctggaggaaaacatggatgtggagatctggacgaaggagggagaaaggaaaaagctcaggccccggtggttggacgctcgcacctactctgaccctctggcactaagagagttcaaagaatttgccgctggtaggcggtccgtcagcggcgatctgattctcgagatcgggaaacttccgcagcatctgacacagcgagcccaaaatgcattagacaacttggttatgctgcacaattcagaacagggaggcagagcgtatcgccatgccatggaggagctcccagatactattgaaaccctgatgcttctggctctcatcgccgtgttgacaggtggggtaaccctgttctttttaagtggcaagggactaggcaaaactagcatagggctgctctgtgtgatggcatcctctgtccttctgtggatggctagcgtggagccccactggatcgccgcatccattatcttggagttctttctgatggttctcctgattcctgagcccgacaggcagcggacgccacaggataaccaacttgcctacgtggtcatcggactcctgttcatgatattgaccgtagctgcgaatgagatgggtctgttagaaacaactaagaaagacctaggcattgggcacgtggccgttgagaaccatcaccatgcagctatgctggatgtggacctccaccctgcctcagcctggaccctttacgcagtcgctacaaccatcattactcccatgatgcgtcatacaatcgaaaacacgaccgccaatatatctctgactgcgatcgctaaccaggccgcaattttgatgggactggataagggctggccaatcagtaaaatggacattggtgtgcctctcctggcccttgggtgctattcgcaggtcaatccgttaacactgaccgctgcagtgctcatgttggttgcccactacgcgatcataggccccggactgcaagctaaggccaccagagaggcacagaagaggacagccgctggcattatgaaaaacccaactgtggatgggatcgtagccatcgacctagatcctgtggtctatgacgcaaagtttgaaaaacagctgggacagattatgctccttatcctgtgtacgagccaaatattgctgatgcgcaccacatgggctctctgcgagtccattactctggccaccggccccttaacaaccctttgggagggttctccagggaagttctggaatactacgatcgcggtttcaatggccaacatttttcggggaagctacctggcaggcgctggtctcgccttctccctaatgaaaagtctgggcgggggacgaagaggcacaggggcacagggagaaaccttgggcgagaagtggaagaggcagctgaatcagctctctaaaagcgagttcaacacttataagcgctcaggtatcatggaggtggaccggtccgaagctaaagaggggcttaagagaggagagaccacaaaacacgccgtcagtcgtggcactgccaagctgaggtggtttgtggaacggaatttggtaaagcctgagggtaaagtgatagatctgggctgtgggcgcggaggctggagctactattgcgcggggctcaagaaagttaccgaagtgaagggatacacaaaaggcggtcccgggcatgaggaaccggtcccaatggctacgtacggatggaacttagtgaagctgcactctggcaaagacgtcttctttatccctcccgagaagtgtgatacccttctgtgcgacattggcgagtcctcaccaaatcccactatcgaagaggggcgaacactaagagtgctcaagatggttgaaccttggctgaggggaaaccaattctgtattaaaatcttgaatccgtatatgcccagcgtagtggagaccctggagcagatgcagcggaagcatggtggcatgctcgtccgcaacccactttcgagaaattctactcacgaaatgtactgggtgagttgcgggacaggaaacattgtttccgcaatcaatatgaccagcaggatgctgttaaaccgatttacgatggcccaccggaaacctacctatgagcgtgatgtggacctgggcgctggtacaagacatgtcgccgtggaacccgaggtagcaaacttggatataattgggcagcgcatcgaaaatatcaagtgtgagcacaaatcaacttggcattacgacgaggataacccttataagacctgggcctaccacggatcctatgaagtgaagccatctggcagcgctagttccatggttaatggcgtcgtgaaactcctgacaaagccctgggacgtgattcctatggtcactcaaatagcgatgaccgatacaaccccattcgggcagcagagggtttttaaagagaaggtggacactcggacgcccaaagccaagagaggaacagcacaaatcatggaagtaaccgctcgctggctatggggtttccttagcaggaacaagaaaccgcgaatttgcactcgggaggaatttaccagaaaggtgaggtctaatgccgcaatcggcgccgtcttcgtggacgagaaccagtggaactcagctaaagaggccgttgaagatgagcgcttttgggacctggtgcatcgtgaacgggagctccacaagcaggggaaatgcgcgacatgtgtctacaacatgatgggaaagagagaaaagaaactgggcgagttcggtaaggcaaaagggagtagggccatttggtacatgtggttgggagctcgctttctggagttcgaagccctcggcttcatgaatgaggatcactggttttcccgagaaaacagcctttctggcgtggagggggagggactgcataagttaggttatatcctgcgggacatatcgaaaatctcaggcgggaatatgtacgcagatgacacggctggatgggataccagaattactgaagacgatttgcagaacgaggccaagatcacagaaattatggagcctgaacacgctcaactcgccaaagcaatcttcaagctgacctatcagaataaggtagttagggtgcagcgcccagcgaaaaacggcactgtcatggacgtgataagcagacgggatcagaggggttccgggcaagtgggaacatacggcctaaatacctttacaaacatggaggcccagcttattcgtcagatggagagtgaaggcatcttctctcccagcgagctggaaactcctaacctcgctgagcgagtcctggactggttggaaaagtatggggttgagcgcttaaaaagaatggccatctccggagatgactgcgtggtaaagccaattgacgatcggtttgcaaccgctctgacggccctcaatgacatgggtaaagtgaggaaggatataccccagtgggagccgtcaaagggctggaacgactggcaacaggtccctttctgtagtcatcactttcaccagcttatcatgaaagatgggcgcgaaattgtggttccctgcagaaatcaggacgagctggtgggacgggcaagggtctctcaaggcgccggttggagcctacgagaaaccgcgtgtctggggaagtcctacgctcagatgtggcagctcatgtatttccatcgtagagatttgcgcctggccgcaaacgccatctgctcagctgtgccagtagactgggttcctacaagccggactacctggtctattcacgcccatcaccaatggatgacaactgaggatatgctttccgtgtggaatagggtctggatcgaagagaacccctggatgaaagacaagacccatataagtagctgggaggatgtgccatacctgggaaaaagagaagaccagtggtgtggctcgctcatcggcttaacggcacgcgctacatgggccaccaatattcaggttgcgatcaaccaggtgcggaggctgattgggaatgagaactacttggactatatgacttccatgaagcgatttaagaatgaatctgatcccgagggagctctgtggtga

SEQ ID NO: 13186 - RNA, 9879 nt, synthetic construct
  misc_feature 1..9879: note = derived and/or modified CDS sequence (opt3) from DENV-1__LC128301__SS-prME
  source 1..9879: mol_type = other RNA
agcgtgaccatgctgctcatgcttctgcccaccgccttggctttccacttaactacgaggggaggggaacctcatatgatcgtctccaagcaggaaaggggaaaatctctgctatttaagacctcagccggtgttaatatgtgcacgctcattgccatggacctgggcgaactttgtgaagatactatgacctacaaatgcccacggataacagaaaccgaaccggacgatgtggactgttggtgcaatgcgactgagacatgggtaacctatgggacgtgtagtcaaactggagagcaccgccgagataagcgtagcgtggctctggcaccccatgtcggcttgggtctcgaaaccagaacagagacttggatgtcctctgaaggggcatggaggcagatccagaaagtggagacctgggccctgcggcaccctggattcacagttattgctctgtttctcgcccatgccatcggcacctcgattacgcagaagggcatcatattcatcttactgatgcttgtgactccatcaatggctatgcgctgcgtcgggattggaaacagggactttgtggagggtttgagcggcgccacatgggtagatgttgtgctggaacacgggagttgtgtcaccactatggcgaaggacaaacccacactagatatcgagctcctgaagaccgaagtgacgaatcctgcagtgcttaggaaactgtgcattgaggccaagatctccaacaccacaactgactctcggtgtccaacccaaggagaagctacattggtcgaggagcaggatactaatttcgtttgccgccgaacctttgtggaccggggctggggtaacgggtgtggactcttcggcaaaggcagcctgataacatgcgccaagtttaagtgcgtaaccaaattagaagggaagattgtgcagtacgagaatctgaaatattccgtcatcgtgactgttcacacgggagatcagcatcaagtgggtaacgaaacaaccgagcacggcactaccgcaacaattacaccccaggctcctacttcagaaatccagctcacagactacggggcccttacgctggactgtagtccaaggaccggattggatttcaatgagatggtcctactgactatgaaggagaaaagctggctcgtgcataagcagtggtttctggaccttccgctgccctggacatctggcgcgtccacctcacaagaaacatggaaccggcaggatttgctcgtaactttcaaaaccgcccacgcaaagaagcaggaggttgtggtcctgggtagccaagaaggggctatgcacacggccttaaccggcgctacagagatccagacaagtggaaccacaactatttttgccggccatctgaaatgccgtctaaagatggacaaactcaccctgaagggggtgtcttatgtcatgtgtacgggatccttcaaacttgaaaaggaggtggcagagacacagcacggtaccgttttggtgcaggtaaagtacgaaggcactgatgccccttgcaaaataccattcagctcgcaagacgagaagggggtcacacagaatggacgcctgatcaccgctaaccccattgtgactgataaagaaaagcctgttaatatcgaggcggagccaccctttggcgaatcttatctcgtggtcggtgcaggggagaaagccctgaaactttcctggttcaagaaaggctcaagtataggaaagatgtttgaagctaccgccagaggcgcaaggcggatggccattctgggggacacagcttgggatttcggaagcatcggtggcgtgtttacgtccgtagggaaattgatccatcagattttcggaaccgcctacggcgtgctcttttctggtgttagctggactatgaagatcgggattggcatactgttaacatggctgggactaaactcacgaagtacctccctcagcatgacatgtatcgcagtcggcatggtgactctgtaccttggggtgatggtccaggcggactctggatgcgttattaattggaaaggccgcgagttgaagtgtggttcagggatcttcgtgaccaacgaagtgcacacgtggacagagcaatataagtttcaggctgatagtccgaaaagactgagcgccgcaatcggaaaggcctgggaggaaggcgtatgcggtattaggtccgctacccggctcgagaacataatgtggaaacagatctctaatgaactgaaccatattttactggagaatgacatgaagttcactgtcgtggttggcgacgtgaacgggatccttgcccagggcaagaagatgattcgccctcaacccatggaacacaaatactcgtggaaaagctggggcaaggcaaaggtcatcggggctgatgtgcagaataccacatttataatcgacggaccaaacactcctgagtgtcccgatgaccagagagcctggaatatttgggaggttgaagattatggcttcggtatctttaccacaaacatttggttgaagctcagggactcctacacacaggtgtgcgatcaccgtctgatgtcagcggccatcaaagacagtaaggctgtacatgcagatatggggtattggatagagtctgagaagaatgagacctggaagctaactcgggccagcttcattgaagtcaagacatgtatctggccaaaatcccacaccctgtggtcaaacggagtgctcgagagcgagatgattatccccaagacttacggcggtcctatatctcaacataattatcgaccaggctacttcacacagaccgctgggccgtggcacctgggaaaacttgaattggactttggcctgtgcgaggggacgactgtggtcgttgatgaacactgcggaaacagaggcccctccttaaggaccacaaccgtgactggtaagatcattcatgagtggtgttgccgcagttgtacactccctccactgcggttcaaaggggaggacggatgctggtacggcatggaaatcagacccgtaaaggagaaggaagagaatcttgtgaggagcatggtctctgccggttccggcgaagtggattcatttagtctggggttgctctgtattagcatcatgatagaggaggttatgcgctcgcgatggtcccggaaaatgctgatgaccggaacactagcagtgttcctgctcctgattatgggccagcttacttggaacgacttgatccgtctgtgcatcatggtcggggcgaatgcctctgacaagatgggaatgggcaccacgtatttagctctcatggccacatttagaatgaggcctatgttcgcagtgggtctgctttttcgccggctgaccagcagagaagttctactcctgactgtggggttgtcactggtcgctagtgtagagttaccaaactccctcgaagaactgggagatggccttgccatgggcattatgatgctgaaattgctcaccgacttccaatctcaccagctgtgggcagccctactgagccttacatttgtgaagactaccttctccctccattacgcttggaaaacgatggcgatgatcctgtcaattatatccttgtttcccctgtgtatgagtacaacctctcagaagactacatggttaccggttctcctggggtcccttggatgcaagcctctgaccatgttcttgatcactgaaaacaaaatttggggtagaaagagctggccactcaatgagggcatcatggccgtggggattgtctcgatcctgctatcatctctgcttaaaaacgatgtgcccctcgcaggacctctgatagctggcggtatgttgatcgcctgttatgtaattagtgggtccagcgccgacttatctctggagaaggctgcagaagtgagctgggaggaagaggccgaacactccggagcgtcacataatatcctcgtcgaggttcaggatgacggcacaatgaaaattaaggatgaggaacgagacgataccctgacgatccttctgaaagctactttgctagccataagtggcgtgtaccccatgagcattccagcaaccctgtttgtgtggtatttctggcaaaagaagaaacagcgctctggggtcctctgggacacaccttcacccccagaggtggaacgggccgttctggatgacggaatctacagaatccttcagaggggtttactgggcaagagccaggtaggggtgggagtcttccaagagggcgtgtttcacaccatgtggcacgttacacgtggtgctgtgctcatgtatcaggggaaacgcttggagccgagttgggcaagcgtcaagaaagatctgatttcctacggaggcggctggcggttccaggggtcttggaacactggagaagaggtgcaggtaatagccgtcgaacctggtaagaatcccaagaacgtgcaaaccgcgccaggcacgtttaaaacacccgagggggaagttggagctatcgccctcgacttcaagcctggcacttcgggtagcccaattgtgaatagagaggggaaaatcgtcggactgtacggcaacggcgtggttaccacatcagggacctatgtgtccgcaattgcccaggctaaggccagtcaggagggaccccttcctgaaatcgaggacgaagtctttaggaaacgaaatctgactataatggatttgcatccgggttctggcaagacccggcgctacctaccagcaatcgtgagagaggctattaagaggaaactgcggacactcgtattagcccccacgcgagtggttgcgagcgaaatggccgaggcactgaaggggatgcctatcagatatcaaactaccgctgtcaaatccgagcacacaggaaaggaaattgtggaccttatgtgccatgccaccttcactatgcgcctgctctcaccagtgagggtccccaactacaatatgatcataatggatgaggctcactttacagaccctgcatctattgccgcccgtggctatatcagcacccgggtaggtatgggggaagctgcggcaatcttcatgacggccactccgcccggaagtatggaggcttttccacagtccaacgccgcaattcaggatgaagagagagacatccctgagaggagctggaactctggctacgattggataacagacttccccggcaaaaccgtgtggtttgttccatcaattaagtccgggaacgatatcgccaattgtttgcgcaagaacggaaaacgagtggtccagctgagtagaaagaccttcgacactgaatatcaaaagactaagaacaatgattgggactacgtggttaccacagacattagcgagatgggtgctaacttccgggcggatagggtgatcgaccctcgccgttgcctcaaacccgtcatactgaaggatggcccagaaagagtgattcttgccgggccgatgcctgtaactgtggcatcggctgcccagcggaggggacgcatcggccgaaatcagaacaaggagggtgaccagtacatctatatggggcaacccctaaataacgatgaggaccatgcacactggacggaagccaaaatgctgttggataatattaacaccccagagggcatcattcccgctttatttgaacctgagagagaaaagtctgccgcgatagacggagagtaccggctgaggggcgaggcacgcaaaacattcgttgaactcatgagaagaggggatctgccagtctggctttcctataaggtggccagcgagggatttcagtactcagaccggcgttggtgcttcgatggtgaacgcaataaccaggtgctggaggaaaatatggacgtcgagatctggactaaagagggcgaacgaaagaaactcagacccaggtggttggatgctcggacctatagtgaccctctggccctacgcgagtttaaggagttcgctgcagggagaaggtctgtttccggagacctgattctcgagatcggcaaacttccgcagcacctgacacaacgggcccagaacgctttagataatttggtgatgctgcataacagcgaacagggtgggaaagcctaccgacacgcaatggaggagctcccagacaccatcgaaactctgatgcttctggcgctcattgccgtattgacgggcggagtgaccctgtttttcttatcaggcagagggctaggaaagacaagtataggtctgctctgtgtcatggctagctccgcccttctgtggatggcatctgtggagccccattggatcgctgccagcattatcttggaatttttcctgatggttctcctgattcctgagcccgatcgccagaggactccacaagacaatcagcttgcatatgtggtcatcggcctcctgtttatgatattgaccgtagccgctaacgagatggggctgttagaaacaaccaaaaaggatctaggaatcggccacgtggcggccgagtcccaccatcacgcagctatgctggacgttgatctccatcctgcctcagcctggactctttacgcagtggctacaacgattatcacccccatgatgcggcacactattgaaaacacaaccgccaatatctctctgaccgcgatagctaaccaggccgcaattttgatgggtctggacaaagggtggccaatcagtaagatggatattggcgtccctctcctggcccttggatgctactcgcaagtgaatccgttaacactgactgctgcagtcctcatgttggtggcccattatgcgatcataggccccgggctgcaggctaaggccacgcgtgaggcacagaaaagaaccgccgctggaatcatgaagaacccaacagttgacggcattgtggccatcgatctagaccctgtagtgtacgatgcaaaattcgaaaagcagctgggtcaaattatgctccttatcctgtgtactagccagatattgctgatgaggaccacatgggctctctgcgagtccattaccctggccactgggcccttaacgacactttgggagggatctccaggcaaattttggaataccactatcgcggtctcaatggccaacatcttccgcggtagctatctggcaggcgctgggctcgccttctccctaatgaagagtctgggaggcgggcggcgaggaaccggcgcacagggtgaaacattgggggagaagtggaaaagacagctgaatcaactctctaagagcgaatttaacacttacaaaaggtcaggaattatggaggttgaccgctccgaagctaaggagggccttaaacggggtgagaccacaaagcacgccgtgagtagaggcacggccaagctgcgttggttcgtcgaaaggaatttggtgaaacctgaggggaaggtaatcgacctgggatgtggcagagggggatggagctattactgcgcgggcctcaaaaaggtgaccgaagttaaaggttatactaaagggggacccggccacgaggaaccgataccaatggctacatacggctggaacttagtgaaactgtactctgggaaggatgtctttttcacccctcccgagaagtgtgacactcttctgtgcgatattggagagtcctcaccaaatcccacaatcgaagagggtcgcaccctacgagtgctcaaaatggtcgaaccttggctgagaggcaaccagttttgtattaaggtgttgaatccgtatatgcccagcgttgtagagacgctggagcagatgcagaggaaacatgggggaatgctcgtgcggaacccactttcgcgcaattctacccacgaaatgtactgggtcagttgcggcacaggtaacatcgtgtccgcagttaatatgactagcagaatgctgttaaacaggttcaccatgacacatcgaaagcctacttatgagaaagacgtggatctgggggccggaacccggcacgtcgctgtggaacccgaggtagccaacttggacataatcggccaacgtattgaaaatatcaagaacgagcacaagtcaacatggcattacgatgaggacaatccttataaaacctgggcataccacggctcctatgaagtgaagccatctgggagcgccagttccatggttaacggagtcgtgagactcctgactaaaccctgggatgtgattcctatggtcacgcagatcgctatgacagacaccactccatttggtcagcaacgcgttttcaaggagaaagtggataccaggacacccaaggcgaagcggggcacggcccagattatggaagtaaccgcaagatggctatgggggtttcttagccgcaataaaaagccgaggatctgtactcgagaggagttcacacggaaagtgagatctaacgctgccataggagcagtctttgtggacgagaatcagtggaactcagccaaggaggctgttgaagacgagaggttctgggatctggtgcatcgcgaacgtgagctccacaaacagggcaagtgcgcaacctgcgtctacaatatgatgggtaagcgggagaaaaagctgggggagtttggaaaagcgaagggcagtagagcaatttggtacatgtggttgggcgccaggttcctggagttcgaagctctcgggtttatgaacgaggaccattggttctcccgcgaaaatagcctttctggagtggagggtgagggcctgcacaaattagggtatatcctgcgagatatctcgaagattcctggaggcaacatgtacgccgacgatactgcaggttgggacacacggataaccgaagatgacttgcaaaatgaggctaaaatcacagatattatggaaccagagcacgccctcctggctacttcaatctttaagctaacctatcagaacaaggtagttagagtgcagaggcccgccaaaaatgggacggtcatggacgtgattagccgcagagatcagcggggatccggccaagtgggcacctacgggcttaacacattcactaacatggaagcacagctgatcaggcagatggagagtgagggaatatttctcccttctgaactggagaccccaaatttggcggaacgtgtcttagactggctggagaagcatggtacagaacgactcaaacgcatggccatcagcggcgatgactgtgttgtgaagcccattgacgatagattcgctactgcccttaccgcactgaacgacatggggaaagtacggaaggatatcccgcagtgggagccttccaagggatggaatgactggcaacaggtgcccttttgctcacaccatttccaccagctaattatgaaagatggcagggagatcgtcgtgccatgtcgcaaccaggacgaactggttggtagagctcgggtgagtcaaggggccggatggtctctcagggagacggcatgcttgggcaagagctatgcccagatgtggcagctgatgtactttcaccgacgtgatcttagactggcggctaatgccatatgttccgcagtccctgtggactgggtacccacatcacgcaccacttggagcattcatgcccaccatcaatggatgacaaccgaagatatgctctctgtttggaaccgggtgtggatcgaggaaaatccatggatggaggacaaaactcacgtctccagttgggaggatgtgccctatttaggcaagagggaagaccagtggtgcgggagcctgatcggattgaccgctagagccacatgggcaacgaacattcaggttgctataaatcaggtgcgccggctgatcggtaacgagaattacctcgactacatgacctcgatgaaaaggttcaagaacgaatccgatcctgagggcgccctttggtga

SEQ ID NO: 13187 - RNA, 9879 nt, synthetic construct
  misc_feature 1..9879: note = derived and/or modified CDS sequence (opt3) from DENV-1__LC011945__SS-prME
  source 1..9879: mol_type = other RNA
agcgtgaccatgctgctcatgcttatgcccacagcactggctttccacttgactacgagaggaggggaacctcatatgatcgtctccaagcaggaaaggggaaaatctttactgtttaagacctcagccggtgttaacatgtgcacactaattgccatggacctcggcgaactgtgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaactactcaagacagaggtgaccaaccctgccgtgctgaggaaactttgcattgaagctaagatctctaatacgaccacagatagccggtgtccaactcaaggagaggccaccctggtcgaagaacaggacgcaaacttcgtttgccgccgaacatttgtggatagaggctggggtaatgggtgtggattgttcggcaaaggctccctcataacttgcgctaagtttaagtgcgtaaccaaactggaggggaagattgtgcagtacgaaaacttaaaatattcagtcatcgtgacagttcacaccggagaccagcatcaagtgggtaatgagagtactgaacacggcacgacagccaccattactccccaggcgcctaccacagagatccagctgaccgactacggggccctcactcttgattgtagcccaaggacaggactggacttcaacgaaatggtcttgctaacgatgaaggagaaatcttggctggtgcataagcagtggtttctcgatctgccgcttccctggacctccggcgcatcaactagccaagagacatggaatcggcaggacctgttggtaaccttcaaaacagctcacgccaagaagcaggaagttgtggtcctcggtagtcaagagggggctatgcacactgccctgaccggcgcaacggaaatccagacctctggaacaactaccatttttgccggccatttaaaatgccgtctgaagatggataaactaacactcaaggggatgtcctatgtgatgtgtactggtagcttcaaactggagaaggaagtcgctgagacccagcacggaacggtgcttgttcagataaagtacgagggcacagacgcgccttgcaaaatcccattctcgacccaagatgaaaagggggtgactcagaacggacgcttgattacagcaaatcccatcgtaaccgacaaagagaagcctgtcaacatagaagccgagccaccctttggcgagtcttatattgtgatcggtgctggggaaaaagccctgaagctctcctggttcaagaaaggctcaagtatcggaaagatgtttgaggcaactgccagaggcgctaggcggatggccattctgggggataccgcatgggacttcggaagcatcggtggcgtttttacatccgtggggaaacttgtccatcagattttcggaacggcgtacggcgtgctgttttctggtgtaagctggaccatgaagatagggatcggcgtgttgctcacttggctgggattaaattcacgaagtacatccctgagcatgacctgtattgctgttggcctagtcacactctacctgggggtgatggtgcaggccgattctggatgcgtcatcaactggaaaggccgcgaacttaagtgtggttcagggatcttcgttactaatgaggtgcacacctggacggaacaatataagtttcaggcagacagtccgaaaagattgagcgccgctattggaaaggcctgggaggagggcgtgtgcggtataaggtccgcaacacggctggaaaacatcatgtggaaacagatttctaacgagctcaatcatatcctgttagaaaacgacatgaagttcaccgtagtcgtgggcgatgttgctgggattctggcccagggcaagaagatgatccgccctcaacccatggagcacaaatactcgtggaaaagctggggcaaggcgaagataatcggggccgacgtgcagaatactacctttattatcgatggaccaaacacacctgaatgtcccgacgatcagagagcttggaatatttgggaggtcgaggactatggcttcggtatctttactaccaacatatggcttaagttgagggattcctacacacaggtgtgcgaccaccgtctcatgtcagcagccattaaagatagtaaggctgttcatgccgacatggggtattggatcgaatctgagaaaaatgaaacgtggaagctggcacgggcgagcttcattgaggtgaagacctgtatctggccaaaatcccacactctatggtcaaacggagtactggaaagcgagatgataatccccaagatttacggcggtcctatctctcaacataattatcgaccaggctacttcacacagaccgccgggccgtggcacctcggaaaactggagcttgattttgacttgtgcgaaggcactacagtcgtggtggatgagcactgcgggaacagaggaccctccctgaggaccacgactgtcaccggcaagattatccatgaatggtgttgccgcagttgtacattacctccactccggtacagaggtgaggacgggtgctggtatggaatggagataaggcccgttaaagaaaaggaggaaaatctggtgaagtccatggtatctgctggctccggtgaggtggactcattcagtcttggcctgttgtgtattagcatcatgatcgaagaggtcatgcgctcgcgatggtcccggaaaatgctcatgaccgggactctggccgtgtttttcctactgattatgggacagctcacatggaacgatctgatccgtctttgcattatggttggcgcaaatgcttctgacagaatggggatgggaaccacatacttggccctgatggcaacttttaagatgaggcctatgttcgccgtgggcttactctttcgccggctgaccagcagagaggtccttctgctaacgataggtctctcactggtggctagtgttgaattgccaaactccctggaggaattaggggatggactcgcgatgggcatcatgattctgaaacttctgacagacttccaatctcaccagttgtgggccaccctcctgagcctaacttttatcaagaccacattctccctgcattatgcatggaaaactattgctatggtgctttcaatcgtcagcctctttcccctgtgtttgagtaccacgtctcagaagacaacctggctgccggtattactcggctccctggggtgcaagcctcttactatgttcctgatagccgagaataaaatctggggaagaaagagctggccattgaacgaaggtattatggccgtgggcatcgtttcgattctcctgtcatctctactgaaaaacgatgtgccccttgctgggcctctcatcgcaggaggcatgctgatagcctgttacgtcattagtggttccagcgcggacttgtctttagagaaggctgccgaggtgagctgggaagaggaagcagagcactccggggcctcacataatatcctggtagaagtgcaggatgacggaacaatgaaaatcaaggatgaggagcgagacgataccctcactattctgcttaaagctacactgttggcagtcagtggcgtttatcccctaagcataccagccaccctgtttgtgtggtacttctggcaaaagaagaaacagcgctctggcgtgctctgggacacgccttcacccccagaagtcgagcgggcggtgctggatgacgggatctatagaattatgcagaggggacttttaggtcgtagccaggttggcgtaggggtgttccaagaaaacgtctttcacactatgtggcacgtgacccgcggagctgttctgatgtaccagggcaagcggctcgagccgagttgggccagcgtgaaaaaggacttgatctcctacggtgggggatggagactgcagggctcttggaatacaggcgaggaagtccaggtgattgcagtagagcctgggaaaaaccccaagaatgtccaaaccgccccaggaacattcaagactcccgaaggtgaggtgggcgctatcgccctcgattttaaacctgggacctcgggaagcccaatagttaacagggaaggcaagatcgtgggtctgtatgggaatggagtcgtgacgacatcaggcacttacgtttccgcaattgctcaggccaaagcgagtcaggagggcccccttcctgagatcgaagacgaggtgttccgaaagcggaacctgaccattatggatttgcatccggggtctggaaaaacacgcagatatctaccagccatcgtcagggaagcaataaagcggaagctgcgaaccctcattttagctcccactagagtggtagccagcgagatggctgaagcactgaaaggtatgcctatccgctaccaaaccacagccgtgaagtccgagcacacgggcaaagagatcgttgaccttatgtgccatgccacttttaccatgaggctgctctcaccagtccgtgtgcccaattataacatgattatcatggatgaagctcacttcacagacccttctagcatagcggcacgggggtacattagtaccagagtgggaatgggcgaggccgctgccatctttatgactgcaacaccgcccggttccgtcgaagccttcccacagagcaatgctgtaattcaggatgaggaaagggacatccctgagcgctcttggaactcagggtatgagtggataaccgattttcccggaaagacggtgtggttcgttccatccattaaaagtggcaatgacatcgcgaactgtttgcgaaagaatggcaagagagtgatccagctgagccggaaaacttttgatacagaataccaaaagaccaaaaacaacgactgggactacgtcgtgaccactgatatttcggagatgggggccaatttcagggcagaccgcgttatcgatcctcgtagatgcctcaagcccgtgattctgaaagacggatctgaacgggtcatacttgctggtccaatgccggtgacagtagcctccgcagcccagaggcgcggccgaatcgggagaaaccataataaggagggagatcagtatatttacatgggccagcctctaaacaatgacgaggatcacgctcactggaccgaagccaagatgctgttggacaacatcaatacacccgagggtatcattccagcgttattcgaacccgagcgggagaaaagcgcagccatagatggggagtataggctgcgcggcgaggctagaaagacttttgtggaactcatgaggcggggagacctgcctgtttggctttcatacaaagtcgccagtgagggcttccaatattctgatcgtcgctggtgctttgacggggaacgaaacaatcaggtgctggaggaaaacatggatgtggagatctggacgaaggagggagaaaggaaaaagctcaggccacggtggttggacgctcgcacctactccgaccccctggcactaagagagttcaaagaatttgccgctggtaggcggagcgtctcaggcgatctgattctcgagatcgggaaacttcctcagcatctgacacagcgagcccaaaatgcattagacaacttggttatgctgcacaatagtgaacagggaggcagagcgtatcgccatgccatggaggagctcccggatactattgaaaccctgatgcttctggctctcatcgccgtgttgacaggtggggtaaccctgttctttttaagcggcaagggactaggcaaaacttccatagggctgctctgtgtgatggcatctagcgtccttctgtggatggcttccgtggagccacactggatcgccgcatcaattatcttggagttctttctgatggttctcctgattcccgagcctgacaggcagcggacgccccaggataaccaacttgcctacgtggtcatcggactcctgttcatgatattgaccgtagctgcgaatgagatgggtctgttagaaacaactaagaaagacctaggcattgggcacgtggccgttgagaaccatcaccatgcagctatgctggatgtggacctccacccagcctctgcctggaccctttacgcagtcgctacaaccatcattactcctatgatgcgtcatacaatcgaaaacacgaccgccaatataagtctgactgcgatcgctaaccaggccgcaattttgatgggactggataagggctggcccatctcgaaaatggacattggtgtgccactcctggcccttgggtgctatagccaggtcaatcctttaacactgaccgctgcagtgctcatgttggttgcccactacgcgatcataggcccgggactgcaagctaaggccaccagagaggcacagaagaggacagccgctggcattatgaaaaaccccactgtggatgggatcgtagccatcgacctagatccagtggtctatgacgcaaagtttgaaaaacagctgggacagattatgctccttatcctgtgtacgtcccaaatattgctgatgcgcaccacatgggctctctgcgagtctattactctggccaccggccctttaacaaccctttgggagggttcacccgggaagttctggaatactacgatcgcggttagcatggccaacatttttcggggatcctacctggcaggcgctggtctcgccttcagtctaatgaaatctctgggcgggggacgaagaggcacaggggcacagggagaaaccttgggcgagaagtggaagaggcagctgaatcagctcagcaaatcagagttcaacacttataagcgctccggtatcatggaggtggaccggagtgaagctaaagaggggcttaagagaggagagaccacaaaacacgccgtcagccgtggcactgccaagctgaggtggtttgtggaacggaatttggtaaagccagagggtaaagtgatagatctgggctgtgggcgcggaggctggtcttactattgcgcggggctcaagaaagttaccgaagtgaagggatacacaaaaggcggtcctgggcatgaggaacccgtcccgatggctacgtacggatggaacttagtgaagctgcactccggcaaagacgtcttctttatcccacctgagaagtgtgatacccttctgtgcgacattggcgagtcaagccccaatccaactatcgaagaggggcgaacactaagagtgctcaagatggttgaaccctggctgaggggaaaccaattctgtattaaaatcttgaatccttatatgccgtcggtagtggagaccctggagcagatgcagcggaagcatggtggcatgctcgtccgcaaccccctttctagaaatagtactcacgaaatgtactgggtgtcctgcgggacaggaaacattgttagcgcaatcaatatgacctcaaggatgctgttaaaccgatttacgatggcccaccggaaaccaacctatgagcgtgatgtggacctgggcgctggtacaagacatgtcgccgtggaacctgaggtagcaaacttggatataattgggcagcgcatcgaaaatatcaagtgtgagcacaaatccacttggcattacgacgaggataacccctataagacctgggcctaccacggatcttatgaagtgaagcctagcggcagtgcttccagcatggttaatggcgtcgtgaaactcctgacaaagccatgggacgtgattcccatggtcactcaaatagcgatgaccgatacaacccctttcgggcagcagagggtttttaaagagaaggtggacactcggacgccaaaagccaagagaggaacagcacaaatcatggaagtaaccgctcgctggctatggggtttcctttctaggaacaagaaaccccgaatttgcactcgggaggaatttaccagaaaggtgaggtcaaatgccgcaatcggcgccgtcttcgtggacgagaaccagtggaatagtgctaaagaggccgttgaagatgagcgcttttgggacctggtgcatcgtgaacgggagctccacaagcaggggaaatgcgcgacatgtgtctacaacatgatgggaaagagagaaaagaaactgggcgagttcggtaaggcaaaagggtccagggccatttggtacatgtggttgggagctcgctttctggagttcgaagccctcggcttcatgaatgaggatcactggtttagccgagaaaactctctttcgggcgtggagggggagggactgcataagttaggttatatcctgcgggacatatcaaaaatcagcggcgggaatatgtacgcagatgacacggctggatgggataccagaattactgaagacgatttgcagaacgaggccaagatcacagaaattatggagccggaacacgctcaactcgccaaagcaatcttcaagctgacctatcagaataaggtagttagggtgcagcgccctgcgaaaaacggcactgtcatggacgtgatatccagacgggatcagaggggtagtgggcaagtgggaacatacggcctaaatacctttacaaacatggaggcccagcttattcgtcagatggagtctgaaggcatcttcagcccatccgagctggaaactcccaacctcgctgagcgagtcctggactggttggaaaagtatggggttgagcgcttaaaaagaatggccatctcaggagatgactgcgtggtaaagcctattgacgatcggtttgcaaccgctctgacggccctcaatgacatgggtaaagtgaggaaggatataccacagtgggagcccagtaagggctggaacgactggcaacaggtcccgttctgttctcatcactttcaccagcttatcatgaaagatgggcgcgaaattgtggttccttgcagaaatcaggacgagctggtgggacgggcaagggtcagccaaggcgccggttggtccctacgagaaaccgcgtgtctggggaagtcatacgctcagatgtggcagctcatgtatttccatcgtagagatttgcgcctggccgcaaacgccatctgcagcgctgtgcccgtagactgggttccaacatctcggactacctggtccattcacgcccatcaccaatggatgacaactgaggatatgcttagtgtgtggaatagggtctggatcgaagagaacccttggatgaaagacaagacccatataagctcgtgggaggatgtgccctacctgggaaaaagagaagaccagtggtgtggctccctcatcggcttaacggcacgcgctacatgggccaccaatattcaggttgcgatcaaccaggtgcggaggctgattgggaatgagaactacttggactatatgacttctatgaagcgatttaagaatgaatcagatccagagggagctctgtggtga

SEQ ID NO: 13188 - RNA, 9879 nt, synthetic construct
  misc_feature 1..9879: note = derived and/or modified CDS sequence (opt3) from DENV-1__LC011949__SS-prME
  source 1..9879: mol_type = other RNA
agcgtgaccatgctgctcatgcttgtccccacagccctggctttccacttgactacgagaggcggggagcctcatatgatcgtttccaagcaggaaaggggaaaatctttactgtttaagacctcagcaggtgtgaacatgtgcacactaattgccatggacctcggcgagctgtgtgaagatactatgacctacaaatgcccacggataacagaggcggaaccggacgatgtagactgttggtgcaatgctaccgatacttgggtgacatatgggacctgtagtcaaacgggagagcaccgccgagacaagcgtagcgtcgcccttgcaccccatgtgggcctgggtttggagactagaaccgaaacatggatgtcctctgagggggcctggaaacagatccagagggttgaaacttgggctctccggcaccctggattcaccgtgattgcactgtttctggcccatgctatcggcacatcgattacccagaagggcatcatattcatcctcttaatgctggtcacgccatcaatggccatgcgctgcgtggggattggaagcagagattttgtagagggtcttagtggcgcgacttgggttgacgtggtcttggagcacgggtcctgtgtgacaaccatggcaaaggataaacccactctggacatcgaactactcaagacagaggtgaccaaccctgccgtcctgaggaaactttgcattgaagctaagatctctaatacgaccacagatagccggtgtccaactcaaggagaggccaccctggttgaagagcaggacgcaaacttcgtgtgccgccgaacatttgtagatagaggctggggtaatgggtgtggattgttcggcaaaggctccctcataacttgcgctaagtttaagtgcgtgaccaaactggaggggaagattgtccagtacgaaaacttaaaatattcagtgatcgttacagtgcacaccggagaccagcatcaagtcggtaatgagagtactgaacacggcacgacagccaccattactccccaggcgcctaccacagagatccagctgaccgactacggggccctcactcttgattgtagcccaaggacaggactggacttcaacgaaatggtgttgctaacgatgaaggagaaatcttggctggtacataagcagtggtttctcgatctgccgcttccctggacctccggcgcatcaactagccaagagacatggaatcggcaggacctgttggttaccttcaaaacagctcacgccaagaagcaggaagtggtcgtgctcggtagtcaagagggggctatgcacactgccctgaccggcgcaacggaaatccagacctctggaacaactaccatttttgccggccatttaaaatgccgtctgaagatggataaactaacactcaaggggacttcctatgtcatgtgtaccggaagcttcaaactggagaaggaagtggctgagacgcagcacggtacagttcttgtgcagataaagtacgagggcaccgacgcgccttgcaaaatcccattctcgactcaagatgaaaagggggtaacacagaacggacgcttgattaccgcaaatcccatcgtcactgacaaagagaagcctgtgaacatagaagccgagccaccctttggcgagtcttatattgttatcggtgctggggaaaaagccctgaagctctcctggttcaagaaaggctcaagtatcggaaagatgtttgaggcaaccgccagaggcgctaggcggatggccattctgggggatacagcatgggacttcggaagcatcggtggcgtgtttacgtccgtcgggaaacttgtgcatcagattttcggaaccgcgtacggcgtactgttttctggtgtgagctggactatgaagatagggatcggcgttttgctcacatggctgggattaaattcacgaagtacctccctgagcatgacatgtattgctgtcggcctagtgactctctacctgggggtgatggtccaggccgataccggatgcgttatcaactggaaaggccgcgaacttaagtgtggttctgggatcttcgtgacgaatgaggtgcacacatggaccgaacaatataagtttcaggcagactcaccgaaaagattgagtgccgctattggaaaggcctgggaggagggcgtatgcggtataaggagcgcaactcggctggaaaacatcatgtggaaacagatttccaacgagctcaatcatatcctgttagaaaacgacatgaagttcaccgtcgtggttggcgatgtggctgggattctggcccagggaaaaaagatgatccgccctcaacccatggagtacaaatattcttggaagtcgtggggcaaggcgaaaataatcggggccgacgtccagaatacaacttttattatcgatggaccaaacacccctgaatgtcccgacgatcagagagcttggaatatttgggaggtggaggactacggcttcggtatctttacaacgaacatatggcttaagttgagggatagctatacccaggtttgcgaccaccgtctcatgtccgcagccattaaagattcaaaggctgtgcacgccgacatggggtactggatcgaaagtgagaaaaatgaaacttggaagctggcacgggcgtctttcattgaggtaaagacatgtatctggccaaaaagccataccctatggtccaacggagtcctggaatcagagatgataatccccaagatttatggcggtcctatcagccaacacaattaccgaccaggctacttcactcagacagccgggccgtggcatctcggaaaactggagcttgattttgacttgtgcgaaggcaccacggtggtggtcgatgagcactgcgggaacagaggaccctctctgaggactaccacagttaccggcaagattatccacgaatggtgttgccgctcctgtactttacctccactccggttcagaggtgaggacgggtgctggtatggaatggagataaggcccgtgaaagaaaaggaggaaaatctggtaaagagtatggtgagcgctggctctggtgaggtcgactccttttcacttggcctgttgtgtattagtatcatgatcgaagaggtgatgcgcagccgatggtcgcggaaaatgctcatgacagggaccctggccgttttctttctactgattatgggacagctcacatggaacgatctgatccgtctttgcattatggtgggcgcaaatgcttccgacagaatggggatgggaactacctacttggccctgatggcaacgttcaagatgaggcctatgtttgccgtcggcttactcttccgccggctgacatctagagaggtgcttctgctaaccataggtctcagcctggttgcttcagtggaattgccaaacagtctggaggaattaggggatggactcgcgatgggcatcatgattctgaaacttctgactgactttcaatcccatcagttgtgggccaccctcctgtctctaacattcatcaagactacctttagcctgcactatgcatggaaaacgatggctatggtcctttccattgtatcactcttccccctgtgtttgagcacaaccagtcagaagactacatggctgccggtgttactcggctctctggggtgcaagcctcttaccatgtttctgatcgccgagaataaaatatggggaaggaagtcctggccattgaacgaaggtatcatggccgttggcattgtgagcatcctcctgtcgtcactactgaaaaacgatgtcccccttgctgggcctctcattgcaggaggcatgctgatcgcctgttacgtgatatctggtagttccgcggacttgagcttagagaaggctgccgaggtatcttgggaagaggaagcagagcatagcggggcctcccacaatattctggtggaagtccaggatgacggaactatgaaaatcaaggatgaggagcgagacgatacactcaccatcctgcttaaagctacgctgttggcagtttcaggcgtgtatcccctaagtattccagccactctgttcgtgtggtacttctggcaaaagaagaaacagcgcagcggcgtcctctgggacaccccttctcccccagaagtggagcgggcggttctggatgacgggatatatagaatcatgcagaggggacttttaggtcgttcccaggtaggcgtgggggtctttcaagaaaacgtgttccatacaatgtggcacgttacccgcggagctgtgctgatgtaccagggcaagcggctcgagccgtcatgggccagtgtcaaaaaggacttgattagctacggtgggggatggagactgcagggctcctggaatacaggcgaggaagtgcaggtaatcgcagtcgagcctgggaaaaaccccaagaatgtgcaaactgccccaggaacctttaagacgcccgaaggtgaggttggcgctattgccctcgatttcaaacctgggacatctggatcgccaatcgtgaacagggaaggcaagatagtcggtctgtatgggaatggagtggttactaccagcggcacatacgtgtcagcaatcgctcaggccaaagcgtcccaggagggcccccttcctgagattgaagacgaggtctttaagaaacgaaacctgaccatcatggatttgcacccggggagtggaaagactcggcgctatctaccagccattgtgagagaagcaatcaagaggaaactgcggaccctcatattagctcccacacgagtagtggcctctgagatggctgaagcactgaagggtatgcctattagataccaaacgactgccgttaaaagcgagcataccggcaaggagatcgtcgaccttatgtgccacgccacattcaccatgcgcctgctctccccagtgagggtgcccaattataacatgatcattatggatgaagctcattttactgacccttcatctatcgcggcacgtgggtacataagcacacgggtcggaatgggcgaggccgctgccattttcatgaccgcaacgccgcccggtagtgtagaagcctttccacagtccaatgctgtgatccaggatgaggaaagagacattcctgagaggagctggaactctgggtatgagtggatcactgatttccccggaaaaacagtttggtttgtgccatcaataaagtccggcaatgacattgcgaactgtttgcgcaagaatggcaaacgagtcatccagctgagtagaaagaccttcgataccgaataccaaaaaactaagaacaacgactgggactacgtggttacaaccgatatcagcgagatgggggccaatttccgggcagacagggtgattgatcctcgccgttgcctcaaacccgtcatcctgaaggacggaccagaaagagtgattcttgctggtccgatgcctgtaacagtggcctcggcagcccagcggaggggccgcatagggcgaaaccacaataaggagggagatcagtatatctacatgggccagcccctaaacaatgacgaggatcatgctcactggactgaagccaaaatgctgttggacaacattaatacgccagagggtatcatccccgcgttatttgaacctgagagagaaaagtctgcagccattgatggggagtatcggctgaggggcgaggctcgcaaaaccttcgttgaactcatgagaaggggagacctgccagtctggctttcctacaaggtggccagcgagggctttcaatattcagatcggcgttggtgcttcgacggggaacgcaacaatcaggtgctggaggaaaacatggatgtcgagatatggacaaaagagggagaacgaaagaaactcagacccaggtggttggacgctcggacttacagtgaccctctggcactacgcgagtttaaggaattcgccgctggtagaaggtctatctccggcgatctgattctcgagatcgggaagcttccgcagcacctgacccagcgggcccaaaatgcattagacaacttggttatgctgcataatagcgaacagggaggccgagcgtatagacacgccatggaggagctcccagatacaattgaaaccctgatgcttctggctctcatcgccgtgttgactggtggggtaacgctgtttttcttatcaggccgcggactaggcaaaaccagtatagggctgctctgtgtgatggcaagctccgtccttctgtggatggcttctgtggagccccattggatcgccgcaagcattatcttggaatttttcctgatggttctcctgattcctgagcccgacaggcagcggacaccacaggataaccaacttgcctacgtggtcatcggactcctgtttatgatattgactgtagctgcgaatgagatgggtctgttagaaaccacaaagaaagacctaggcattgggcacgtggccgttgagaaccaccatcacgcagctatgctggatgtggacctccatcctgcctccgcctggaccctttacgcagtcgctactacaatcattacgcccatgatgcgtcacaccatcgaaaacactacagccaatatatcactgaccgcgatcgctaaccaggccgcaattttgatgggactggataagggctggccaatctctaaaatggacattggtgtgcctctcctggcccttgggtgctatagtcaggtcaatccgttaaccctgacagctgcagtgctcatgttggttgcccattacgcgatcataggccccggactgcaagctaaggccactagagaggcacagaagaggacggccgctggcattatgaaaaacccaaccgtggatgggatcgtagccatcgacctagatcctgtggtctatgacgcaaagttcgaaaaacagctgggacagattatgctccttatcctgtgtacatcgcaaatattgctgatgcgcactacctgggctctctgcgagagcattacactggccaccggccccttaactacgctttgggagggttccccagggaagttttggaatacaaccatcgcggtttctatggccaacattttccggggatcatacctggcaggcgctggtctcgccttcagcctaatgaaatccctgggcgggggacgaagaggcactggggcacagggagaaaccttgggcgagaagtggaagaggcagctgaatcagctcagtaaatctgaatttaacacatataagcgcagcggtatcatggaggtggaccggtcagaagctaaagaggggcttaagagaggagagactaccaaacacgccgtctcccgtggcacagccaagctgaggtggttcgtggaacggaatttggtaaagcctgagggtaaagtgatagatctgggctgtgggcgcggaggctggagttactattgcgcggggctcaagaaagttacggaagtgaagggatacaccaaaggcggtcccgggcacgaggaaccgatcccaatggctacttacggatggaacttagtcaagctgcatagcggcaaagacgtgtttttcattcctcccgagaagtgtgatacacttctgtgcgacatcggcgagtcttccccaaatcccaccattgaagaggggcgaactctaagagtcctcaagatggtggaaccttggctgaggggaaaccaattttgtatcaaaattttgaatccgtatatgccctcagttgtagagacactggagcagatgcagcggaagcacggtggcatgctcgtgcgcaacccacttagcagaaattcgacccatgaaatgtactgggtctcttgcgggacgggaaacatcgtgagtgcagttaatatgacctccaggatgctgttaaaccgattcacaatggcccaccggaaacctacttatgagcgtgatgtggacctgggcgctggtaccagacacgtcgccgtggaacccgaggtagcaaacttggatataattgggcagcgcatcgaaaatatcaagcatgagcacaaaagcacatggcattacgacgaggataacccttataagacttgggcctaccacggatcatatgaagtgaagccatccggctctgctagcagtatggttaatggcgtcgtgaaactcctgaccaagccctgggacgtgattcctatggtcacacaaatagcgatgaccgatactacgccatttgggcagcagagggttttcaaagagaaggtggacacacggacccccaaagccaagagaggaactgcacaaatcatggaagtaaccgctcgctggctatggggttttctttccaggaacaagaaaccgcgaatttgtacacgggaggaattcacgagaaaggtgaggagcaatgccgcaatcggcgccgtctttgtggacgagaaccagtggaattctgctaaagaggccgttgaagatgagcgcttctgggacctggtgcatcgtgaacgggagctccacaagcaggggaaatgcgcgacctgcgtctacaacatgatgggaaagagagaaaagaaactgggcgagtttggtaaggcaaaagggtcaagggccatttggtacatgtggttgggagctcgcttcctggagttcgaagccctcggctttatgaatgaggatcactggttcagtcgagaaaactcccttagcggcgtggagggggagggactgcataagttaggttatatcctgcgggacatatctaaaatccctggcgggaatatgtacgcagatgacactgctggatgggatacaagaattaccgaagacgatttgcagaacgaggccaagatcactgacattatggaaccagagcacgctctcctggccaaagcaatctttaagctaacatatcaaaataaggtagttagggtgcagcgccccgcgaaaaacggcaccgtcatggatgtgatatcgagacgggaccagaggggttcagggcaggtgggaacatacggccttaatactttcaccaacatggaagcccaactgattcgtcagatggagagcgagggcatctttctcccttccgaactggagacgccaaacttggctgaacgagtcttagattggctggagaagtatggggttgaacgcctcaaaagaatggccatcagtggagacgactgtgtggtaaagcccattgatgaccggttcgcaaccgctcttacagccctgaatgatatgggtaaagtgaggaaggacataccgcagtgggagccttctaagggctggaacgattggcagcaagtccccttttgcagccatcacttccaccagctaatcatgaaagacgggcgcgagattgtggttccatgtagaaatcaggatgaactggtgggacgggcaagggtctcccagggcgccggttggtcactccgagagactgcgtgcttggggaagagttacgctcaaatgtggcagctgatgtattttcatcgtagagaccttcgcctggccgcaaacgccatctgttctgctgtgcctgtagattgggttcccaccagccggacaacttggtccattcacgcccatcaccagtggatgaccacggaagacatgctctcagtgtggaatagggtctggatcgaggaaaacccatggatggaggataaaacacatataagctcttgggaggacgtgccctacttaggaaagagagaagaccaatggtgcggctccctgatcggcttgaccgcacgcgctacttgggccacaaatattcaggttgcgatcaaccaggtgcggaggctgattgggaatgagaactacctcgattatatgaccagtatgaaacgattcaagaatgaaagcgaccctgagggagctctttggtga

SEQ ID NO: 13189 - RNA, 9879 nt, synthetic construct
  misc_feature 1..9879: note = derived and/or modified CDS sequence (opt3) from DENV-1__HM469966__SS-prME
  source 1..9879: mol_type = other RNA
agcgtgaccatgctgctcatgcttatgcccacagcactggctttccacttgactacgaggggaggggagcctcatatgatcgtctccaagcaggaaaggggaaaatctttactgtttaagacctcagccggtgttaatatgtgcacactaattgccatggacctcggcgagctgtgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaactactcaagacagaggtgaccaaccctgccgtgctgaggaaactttgcattgaagctaagatctctaatacgaccacagatagccggtgtccaactcaaggagaggccaccctggtcgaagaacaggacgcaaacttcgtttgccgccgaacatttgtggatagaggctggggtaatgggtgtggattgttcggcaaaggctccctcatgacttgcgctaagtttaagtgcgtaaccaaactggaggggaagatagtgcagtacgaaaacttaaaatattcagtcattgtgacagttcacaccggagaccagcatcaagtgggtaatgagagtactgaacacggcacgacagccaccatcactccccaggcgcctaccacagagattcagctgaccgactacggggccctcactcttgattgtagcccaaggacaggactggacttcaacgaaatggtcttgctaacgatgaaggagaaatcttggctggtgcataagcagtggtttctcgatctgccgcttccctggacctccggcgcatcaactagccaagagacatggaatcggcaggacctgttggtaaccttcaaaacagctcacgccaagaagcaggaagttgtggtcctcggtagtcaagagggggctatgcacactgccctgaccggcgcaacggaaatccagacctctggaacaactaccatctttgccggccatttaaaatgccgtctgaagatggataaactaacactcaaggggatgtcctatgtgatgtgtactgggtcgttcaaactggagaaggaagtcgctgagacccagcacggtacggtgcttgttcagattaagtacgagggcacagacgcgccttgcaaaataccattctcgacccaagatgaaaagggggtgactcagaacggacgcttgatcacagcaaatcccattgtaaccgacaaagagaagcctgtcaacatcgaagccgagccaccctttggcgagtcttatatagtgattggtgctggggaaaaagccctgaagctctcctggttcaagaaaggctcaagtatcggaaagatgtttgaggcaactgccagaggcgctaggcggatggccatcctgggggataccgcatgggacttcggaagcattggtggcgtttttacatccgtggggaaacttgtccatcagatcttcggaacggcgtacggcgtgctgttttctggtgtaagctggaccatgaagattgggataggcgtgttgctcacttggctgggattaaattcacgaagtacatccctgagcatgacctgtatcgctgttggcctagtcacactctacctgggggtgatggtgcaggccgattctggatgcgtcattaactggaaaggccgcgaacttaagtgtggttcagggatcttcgttactaatgaggtgcacacctggacggaacaatataagtttcaggcagacagtccgaaaagattgagcgccgctatcggaaaggcctgggaggagggcgtgtgcggtattaggtccgcaacacggctggaaaacataatgtggaaacagatctctaacgagctcaatcatattctgttagaaaacgacatgaagttcaccgtagtcgtgggcgatgttgctgggatcctggcccagggcaagaagatgattcgccctcaacccatggagtacaaatattcgtggaaaagctggggcaaggcgaagatcataggggccgacgtgcagaatactacctttatcattgatggaccaaacacacctgaatgtcccgacgatcagagagcttggaatatctgggaggtcgaggactacggcttcggtatttttactaccaacatctggcttaagttgagggattcctatacacaggtgtgcgaccaccgtctcatgtcagcagccataaaagatagtaaggctgttcacgccgacatggggtactggattgaatctgagaaaaatgaaacgtggaagctggcacgggcgagcttcatcgaggtgaagacctgtatttggccaaaatcccatactctatggtcaaacggagtactggaaagcgagatgatcatacccaagatctatggcggtcctatttctcaacacaattaccgaccaggctacttcacacagaccgccgggccgtggcatctcggaaaactggagcttgattttgacttgtgcgaaggcactacagtcgtggtggatgagcactgcgggaacagaggaccctccctgaggaccacgactgtcaccggcaagatcattcacgaatggtgttgccgcagttgtacattacctccactccggttcagaggtgaggacgggtgctggtatggaatggagatcaggcccgttaaagaaaaggaggaaaatctggtgaagtccatggtatctgctggctccggtgaggtggactcatttagtcttggcctgttgtgtataagcattatgatcgaagaggtcatgcgctcgcgatggtcccggaaaatgctcatgaccgggactctggccgtgttctttctactgatcatgggacagctcacatggaacgatctgattcgtctttgcatcatggttggcgcaaatgcttctgacagaatggggatgggaaccacatacttggccctgatggcaactttcaagatgaggcctatgtttgccgtgggcttactcttccgccggctgaccagcagagaggtccttctgctaacgattggtctctcactggtggctagtgttgaattgccaaactccctggaggaattaggggatggactcgcgatgggcataatgatcctgaaacttctgacagactttcaatctcatcagttgtgggccaccctcctgagcctaactttcattaagaccacattttccctgcactatgcatggaaaactatggctatggtgctttcaatcgtcagcctcttccccctgtgtttgagtaccacgtctcagaagacaacctggctgccggtattactcggctccctggggtgcaagcctcttactatgtttctgattgccgagaataaaatctggggaagaaagagctggccattgaacgaaggtataatggccgtgggcatcgtttcgattctcctgtcatctctactgaaaaacgatgtgccccttgctgggcctctcatcgcaggaggcatgctgattgcctgttacgtcatcagtggttccagcgcggacttgtctttagagaaggctgccgaggtgagctgggaagaggaagcagagcattccggggcctcacacaatatactggtagaagtgcaggatgacggaacaatgaaaattaaggatgaggagcgagacgataccctcactatcctgcttaaagctacactgttggcagtcagtggcgtttatcccctaagcatcccagccaccctgttcgtgtggtacttctggcaaaagaagaaacagcgctctggcgtgctctgggacacgccttcacccccagaagtcgagcgggcggtgctggatgacgggatttatagaataatgcagaggggacttttaggtcgtagccaggttggcgtaggggtgtttcaagaaaacgtcttccatactatgtggcacgtgacccgcggagctgttctgatgtaccagggcaagcggctcgagccgagttgggccagcgtgaaaaaggacttgatctcctacggtgggggatggagactgcagggctcttggaatacaggcgaggaagtccaggtgattgcagtagagcctgggaaaaaccccaagaatgtccaaaccgccccaggaacatttaagactcccgaaggtgaggtgggcgctatcgccctcgatttcaaacctgggacctcgggaagcccaattgttaacagggaaggcaagatcgtgggtctgtatgggaatggagtcgtgacgacatcaggcacttacgtttccgcaatagctcaggccaaagcgagtcaggagggcccccttcctgagatcgaagacgaggtgtttcgaaagcggaacctgaccattatggatttgcacccggggtctggaaaaacacgcagatatctaccagccatcgtcagggaagcaattaagcggaagctgcgaaccctcatcttagctcccactagagtggtagccagcgagatggctgaagcactgaaaggtatgcctatacgctaccaaaccacagccgtgaagtccgagcatacgggcaaagagattgttgaccttatgtgccacgccactttcaccatgaggctgctctcaccagtccgtgtgcccaattataacatgatcatcatggatgaagctcattttacagacccttctagcattgcggcacgggggtacatcagtaccagagtgggaatgggcgaggccgctgccatattcatgactgcaacaccgcccggttccgtcgaagcctttccacagagcaatgctgtaattcaggatgaggaaagggacatccctgagcgctcttggaactcagggtatgattggattaccgacttccccggaaagacggtgtggtttgttccatccatcaaaagtggcaatgatatagcgaactgtttgcgaaagaatggcaagagagtgattcagctgagccggaaaactttcgacacagagtaccaaaagaccaaaaacaacgactgggattacgtcgtgaccactgacatctcggaaatgggggccaatttcagggcagatcgcgttatcgaccctcgtagatgcctcaagcccgtgattctgaaagatggaccagagcgggtcgtgcttgctggtccgatgcctgtaacagtggcctctgcagcccagaggcgcggccgaatcgggagaaaccacaataaggaaggagaccagtatatttacatgggccagcccctaaacaatgatgaggaccatgctcactggaccgaggccaagatgctgttggataacataaatacaccagaaggtatcattcccgcgttatttgagcctgaacgggagaaatccgcagccatcgacggggaatataggctgcgcggcgaggctagaaagactttcgttgagctcatgaggcggggagatctgccagtctggcttagctacaaagtggcctcagaaggctttcaatatagtgaccgtcgctggtgcttcgatggggagcgaaacaatcaggtgctggaagagaacatggacgtcgaaatctggacgaaggagggagagaggaaaaagctcaggccccggtggttggacgctcgcacctactctgatcctctggcactaagagaatttaaagagttcgccgctggtaggcggtccgttagcggcgacctgattctcgaaatagggaaacttccgcagcacctgacacagcgagcccaaaatgcattagataacttggtgatgctgcataattcagagcagggaggcagagcgtatcgccacgccatggaagaactcccagacactatcgagaccctgatgcttctggctctcattgccgtattgacaggtggggtgaccctgtttttcttaagtggcaggggactaggcaagactagcatcgggctgctctgtgtcatggcatcctctgtgcttctgtggattgctagcgttgaaccccattggatcgccgcatccataatcttggagtttttcctgatggtgctcctgattcctgaacccgatcggcagcgtacgccacaggacaaccaacttgcctacgtcgtaatcggactcctgtttatgattttgaccgtggctgcgaatgagatgggtctgttagagacaactaaaaaggatctaggcatcgggcacgttgccgtggaaaaccaccatcacgcagctatactggacgtcgatctccatcctgcctcagcctggaccctttacgcagtggctacaaccattatcactcccatgatgagacacacaattgagaacacgaccgccaatatctctctgactgcgatagctaaccaggccgcaatcttgatgggactggacaaaggctggccaattagtaagatggatatcggtgtccctctcctggcccttgggtgctatagccaggtgaatccgttaacactgaccgctgcagttctcatgttggtggcccattacgcgattatcggccccggactgcaagctaaagccaccagggaagcacagaagcgcacagccgctggcataatgaagaacccaactgtagacgggattgtggccatcgatctagaccctgtcgtttatgacgcaaaattcgagaagcagctgggacagatcatgctccttattctgtgtacgagccaaatcttgctgatgcggaccacatgggctctctgcgaatccataactctggccaccggccccttaacaaccctttggaaaggttctccagggaagttttggaatactacgattgcggtgtcaatggccaacatcttccgaggaagctacctggcaggcgctggtctcgccttctccctaatgaaaagtctgggcgggggaagaaggggcacaggggcacagggagagaccttgggcgagaagtggaagcgccagctgaatcagctctctaaaagcgaatttaacacttataagcggtcaggtattatggaggtcgatagatccgaagctaaagaggggcttaagcgtggagaaaccacaaaacacgccgtgagtaggggcactgccaagctgcggtggttcgtagagcgcaatttggtgaagcctgagggtaaagttatcgacctgggctgtgggcgaggaggctggagctactattgcgcggggctcaagaaagtgaccgaagtcaagggatacacaaaaggcggtcccgggcacgaggaaccgataccaatggctacgtacggatggaacttagtgaagctgtattctggcaaagatgtctttttcatccctcccgagaagtgtgacacccttctgtgcgatattggcgaatcctcaccaaatcccactatcgaggaggggagaacactaagggtgctcaagatggttgaaccttggctgcggggaaaccaattttgtattaaaatcttgaatccgtacatgcccagcgtagtggagaccctggaacagatgcagcgcaagcatggtggcatgctcgtcagaaacccactttcgagaaattctactcacgagatgtattgggtgagttgcgggacaggaaacattgtttccgcagtgaatatgaccagccgaatgctgttaaaccggttcacgatggcccatcgtaaacctacctacgagagagacgtcgatctgggcgctggtacacgccacgtggccgtagaacccgaggtggcaaacttggacatcatagggcagaggattgaaaatatcaagcacgagcataaatcaacttggcactatgatgaagacaacccttacaagacctgggcctatcatggatcctacgaggttaagccatctggcagcgctagttccatggtcaatggcgtggtgaaactcctgacaaagccctgggatgtcatccctatggttactcaaattgcgatgaccgacacaaccccatttgggcagcagcgggtgttcaaagagaaggtagacactagaacgcccaaagccaagcgcggaacagcacaaataatggaagtgaccgctaggtggctatggggttttcttagccgaaacaagaaaccgcggatctgtactagagaggagttcaccaggaaggtccgctctaatgccgcaattggcgccgtgtttgttgatgagaaccagtggaactcagctaaagaagccgtggaggacgagcgtttctgggatctggtccaccgggaaagagagctccataagcaggggaaatgcgcgacatgcgtgtacaacatgatgggaaagagggaaaagaaactgggcgagtttggtaaggcaaaagggagtcgcgccatctggtatatgtggttgggagctcgattcctggagttcgaggccctcggctttatgaatgaggaccactggttctcccgggaaaacagcctttctggcgtagagggggaaggactgcacaagttaggttacattctgagagatatctcgaaaatacctggcgggaatatgtatgcagacgatacggctggatgggacaccaggatcactgaggatgacttgcagaacgaggccaagattacagatatcatggaaccagagcatgctctcctggccaaagcaatttttaagctaacctaccaaaataaggttgtgcgcgtccagagacccgcgaaaaacggcactgtgatggacgtgatctcacggagggatcagcgtggtagcgggcaggtcggaacatatggccttaataccttcacaaacatggaagcccaactgatacgacagatggagtccgaaggcatttttagtccttctgagctcgagactccaaacctggctgaacgcgttttggactggttagagaagtacggggtggaaagactgaaacggatggccatcagcggagacgattgtgtagtgaagcccatcgacgataggttcgcaaccgctctcacggcccttaatgacatgggtaaagtccgcaaggatattccgcagtgggagccttccaagggctggaacgactggcagcaagtgcccttttgctcacaccatttccaccagctgataatgaaagatgggagagaaatcgttgtgccatgtcggaatcaggacgagctagtcggaagggcacgagtgagtcagggcgccggttggtctctgcgtgagaccgcgtgcctcggaaagagctatgctcaaatgtggcagttgatgtactttcacagacgcgatctgcggcttgccgcaaacgccatttgttccgctgtacctgttgactgggtgcccacatcaaggactacctggagcatccatgcccaccatcagtggatgacaactgaagatatgctgtctgtctggaatagagtgtggattgaggaaaacccatggatggaggacaaaacccacatctccagttgggaagacgttccctacctcggaaagcgcgaggatcaatggtgcggcagcttaataggcctgacggcacgggctacatgggccaccaatatccaggtggcgattaaccaggtcaggcgattgatcgggaatgagaactatctggactacatgacttcgatgaaaagattcaagaatgaatccgatcctgagggagctctctggtga

SEQ ID NO: 13190 - RNA, 9879 nt, synthetic construct
  misc_feature 1..9879: note = derived and/or modified CDS sequence (opt3) from DENV-1__JX669462__SS-prME
  source 1..9879: mol_type = other RNA
agcgtgaccatgctgctcatgcttctgcccaccgccttggctttccacttaactacgagaggaggggaacctcatatgatcgtctccaagcaggaaaggggaaagtctctgctatttaagacctcagccggtgttaatatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagagaagcgtagcgtggccctggcaccccatgtcggcttgggtctcgaaactagaaccgagacatggatgtcctctgaaggggcctggaggcagatccagcgggtggagacttgggctctgcgccaccctggattcaccgttattgcatttttcctggcccatgctatcggcacatcgattacccagaaaggcatcatatttatcctcttaatgctggtgacgccatcaatggccatgagatgcgtcgggattggaaacagggacttcgtggagggtcttagcggcgcgacttgggtagatgttgtgttggaacacgggagttgtgtcacaaccatggcaaagaataagcccactctggacatcgagctactcaaaacagaagtgaccaaccctgccgtgctgcggaaactttgcattgaggctaaaatctccaatacgaccacagattctcgctgtccaactcaaggagaagccaccctggtcgaggagcaggacgcaaactttgtttgccgaagaacattcgtggataggggctggggtaatgggtgtggattgtttggcaagggcagcctcctgacttgcgctaaattcaagtgcgtaaccaagttagaagggaaaatagtgcagtacgagaacctgaagtattccgtcattgtgacagttcacaccggagaccagcatcaagtgggtaatgaaactacggagcacggcacaatcgccaccattactccccaggcgcctacctcagaaatccagctcacagattacggggcccttaccctggactgtagtccacggactggattggactttaacgagatggtcctactgacaatgaaagaaaagagctggctcgtgcataaacagtggttcctggatcttccgctgccctggacgtctggcgcatccacctcacaagaaacttggaatcgtcaggacttgctcgtaacatttaagaccgctcacgccaaaaagcaggaggttgtggtcctgggtagccaagaaggggctatgcacacagccttaactggcgcaaccgagatccagacgagtggaaccacaactattttcgccggccatctgaagtgccgcctaaaaatggataagctcaccctgaaagggatgtcttatgtgatgtgtacaggatccttcaaacttgaaaaagaggtcgctgagactcagcacggtaccgtgttggttcaggtgaagtacgaaggcacggacgcgccttgcaagataccatttagcacacaagatgagaaaggggtaacccagaacggaagactgatcactgcaaatcccattgtcacagacaaggaaaaacctgtgaacatcgagaccgagccacccttcggcgaatcgtatatagttgtgggtgccggggagaaggctctcaaactgtcttggtttaagaggggctcctcaattggaaagatgttcgaagccactgcacggggcgcccgacgcatggctatccttggggataccgcctgggactttggaagtatcggtggcgtcttcacaagcgtggggaaactggtacatcaggtgtttggaacggcatacggcgttttgttctccggtgtctcttggaccatgaagattgggatcggcattctcctgacttggttaggactgaatagcagatcaacaagtctatccatgacctgtatagcggtgggcatggtgacactctacctgggggtcatggttcaggctgatagcggatgcgtgatcaactggaaaggcagggagcttaagtgtggttctgggatttttgtgactaacgaagtacacacctggacggagcaatataaattccaggccgactcaccgaagcggttgagtgcagccatcggaaaggcttgggaggaaggcgtctgcggtatccgcagcgccacaagactggagaatattatgtggaaacagatatccaacgaactcaatcatatcctgttagagaacgatatgaagtttaccgtggttgtgggcgacgcaaatgggattctggctcagggcaagaagatgatcaggcctcaacccatggaacacaaatactcttggaagtcgtggggcaaagccaagattatcggggcggacatacagaacactaccttcatcattgatggaccagacacacctgagtgtcccgatggccagcgtgcctggaatatctgggaggtcgaagactatggttttggggtgttcactaccaacatttggcttaagttgcgggatagctacacacagatgtgcgaccaccgactcatgtccgctgcaatcaaagattcaaaggccgttcatgctgacatgggatattggatagagagtgagaagaatgagacgtggaagctggccagagcatctttcattgaagtgaaaacctgtacttggccaaagagccacacactatggtccaacggcgtactggagtcagagatgatcattcccaagatctttggtggccctataagccaacataattacaggccagggtatttcacccagactgcgggaccgtggcacctcggcaaactggaacttgattttgacttgtgcgaggggacaaccgtcgtggtggatgaacactgcggaaaccgcggcccctctctgcggacgactaccgtcacaggtaagatcattcatgagtggtgttgcagatcctgtaccttacctccactcaggttccgcggggaggacggatgctggtacggcatggaaatccgacccgttaaagagaaggaagagaatctggtgcggagtatggtaagcgccggttctggcgaagtggattccttttcacttgggattctgtgtgtcagtatcatgatagaggaggtgatgcgtagcagatggtcgaggaaaatgttgatgactggaacactcgctgttttcctgctactgattatgggccagctcacctggaacgacctgatccgcctttgcatcatggtgggggccaatgcatccgaccggatgggaatgggcacaacttacttggctctgatggccaccttaaagatgagacctatgtttgcagtcggtctcctgttcaggcgacttacgtctcgcgaagtgctgctactcacaattgggctgagcttggttgcctcagtggagctgccaaacagtttagaggaactcggagatggcctggctatgggcatcatgatgcttaagctgttgaccgaatttcaaccccaccagctctggactaccctgctatccctgacattcgtcaaaactaccctttctctcgactatgcgtggaagacgacagccatggtactgagcattgtgtccttgtttccgctgtgtttatcaaccactagccagaaaacaacctggctccctgttctgcttgggagtttcggatgcaagccactgactatgtttttgataacagagaacaaaatctggggtcggaagtcttggcccctcaatgagggcattatggcaatcgggattgtgtccatcctgctaagctcgctgcttaagaacgatgtccctctcgctggacccctgatagccggcggtatgttgatcgcctgttacgtgatttcagggtctagtgctgacttatccctggaaaaagcagccgaggtaagctgggaacaggaggcggaacattctggagctagccacaatatcctcgtggaggtccaagatgacggcaccatgaagattaaagatgaggaaagagacgatacgctgactatccttctgaaggccaccttgctagcagtttccggcgtgtatccaatgtcaatacctgccacactgttcgtgtggtacttctggcagaaaaagaaacagaggagtggggtcctctgggacacccccagcccaccggaggtggaacgtgctgttctggatgacggaatttatcgcatccttcagcggggtttactgggcagatctcaagtaggggtgggagtctttcaggatggcgtgttccatacaatgtggcacgttactaggggtgcagtgctcatgtaccaggggaagcgattggagccttcctgggcctcagtcaagaaagacctgatcagttatggaggcggctggcggtttcaggggagctggaacaccggagaggaagtgcaagtaattgcggtcgagcccggtaagaatcccaagaatgtgcagacgacacccggcactttcaagacccctgaaggggaggttggagctatagccctcgactttaaaccaggcacatccggttctcccatcgtgaatcgcgaagggaagattgtcggactgtacggcaacggcgtggttaccacttcggggacctacgtgagcgcaatcgcccaggctaaggcctcacaagagggacctcttccggagattgaagatgaggtcttcaaaaagagaaatctgacaatcatggacttgcacccaggttccggcaaaacgaggcggtatctacccgcaatagtgcgagaagctatcaagagaaaactgcgcactctcattttagcccctaccagggtagtggcgagtgagatggccgaagcactgaaggggatgccaatccgttaccagacaaccgctgttaagtctgagcatactggacgggagattgtcgatcttatgtgccacgccacatttaccatgagactgctcagccccgtgagggtgcctaactataatatgatcataatggacgaagctcatttcacggatccggcatccattgccgcccgcggctacatctcaactcgagtcggtatgggggaggctgcggcaatctttatgacagccacaccaccaggatctgtagaggctttccctcagagcaacgccgtgattcaggacgaggaaagagatatccccgagcggagttggaactccggctatgactggataaccgattttccaggcaaaactgtttggttcgtgcctagcattaagtctgggaacgacatcgcaaattgtttgaggaaaaacggaaagcgcgtcattcaactgtcacgtaaaacattcgataccgagtaccagaagacaaagaacaatgactgggactatgtggttactacggatatctccgaaatgggtgccaactttagagctgaccgggtgatagatcccaggcgctgcctcaaaccagtcattctgaaggacggcccggagcgagtgatccttgcggggcctatgcccgtaaccgtggccagtgcagctcagagacggggaaggatcggccgcaatcagaacaaagaaggtgatcaatacgtttacatggggcagccactaaataacgacgaggatcacgcccattggacagaggcaaagatgctgttggacaatattaacactcccgaaggcatcattcctgccttattcgagccagaaagagagaaaagcgctgccatagatggagaatataggctgcggggcgaggcgcgtaagacctttgtcgagctcatgcgccgaggggacctgcccgtgtggctttcgtacaaggtggcatctgaaggattccagtattccgatagaaggtggtgctttgacggtgagcggaataaccaggtcctggaagagaatatggatgttgaaatctggacaaaagagggcgagcgcaagaaactcagacctaggtggttggacgcccggacctacagcgacccgctggctctacgagagttcaaggagtttgccgctgggagacgctcagtgagtggagatctgattctcgaaatcggcaaacttccacaacacctgactttaagggcacagaacgccttggacaatctggtaatgctccacaactctgagcagggtgggaaggcttatcggcatgccatggaagaactgcccgatacgatcgagacccttatgctgctcgcattgattgcggtgctgacaggcggagtcactttattctttctatccggcaaagggctgggaaagaccagcataggtctcctttgtgtgacagcctcaagtgctctgttgtggatggccagcgttgaacctcactggatcgcagcttccattatcctggagttctttctcatggtgctgcttattcccgaaccagaccgtcagagaacccctcaagataatcagctcgcctacgtcgtaatcggcctgttgttcatgatactgactgtggcagccaacgagatggggttactagagacaacgaagaaagacctgggaatcggctatgttgctgcggaaaaccatcagcacgccaccatgctcgatgtggaccttcaccccgcatctgcttggactctgtacgccgtcgccacaaccgtgattaccccaatgatgaggcatacaatcgagaatactacggcaaacattagcttgaccgctatcgccaatcaagcggctatactgatgggtctcgataaggggtggcctatttccaaaatggacatcggcgtcccgctgcttgccttaggatgctactcacaggtgaaccccctgacactcactgcagccgttttgatgctggtggctcactatgcaattatcggcccagggctacaggccaaggcgacccgcgaagctcagaaacggacagccgcaggaataatgaagaatcctaccgtagatggcatcgtggccattgacctggatcccgtcgtttacgacgctaagtttgagaaacaactcggtcagatcatgcttctgattttgtgtacttctcagatcctgctcatgcgaacgacatgggccctgtgcgaaagtataaccttagcaactgggccacttaccacactgtgggagggatcgcctggcaagttctggaacactaccattgctgtgagcatggccaatatcttcagaggttcctatctcgcgggcgccgggctagcattttctctgatgaaatcattgggaggcgggaggcgcggaacaggcgctcagggtgagacgctgggggaaaagtggaaacggcaactcaaccagcttagcaagtccgagttcaatacctacaagagaagtggaatcatggaagtcgaccgttctgaggccaaagaaggcctgaagaggggtgagactacaaaacatgcagtgagccggggcaccgctaagttgcgctggtttgtagagcgaaacctggtgaaacccgaagggaaggttattgatctcggatgtggcagagggggatggtcatattactgcgccggcttaaagaaagtgactgaggtcaagggttatacaaaagggggaccgggccacgaagaaccaatccctatggccacctacggctggaatctggtgaaacttcattccgggaaagacgtcttctttatgcccccagaaaagtgtgatacgctgctatgcgacataggagagagtagccccaaccctaccattgaggaaggtaggacactccgggtgctgaaaatggttgagccgtggttgcgcggcaatcagttctgtatcaagattctgaacccctacatgccatctgtagtggaaactctcgagcagatgcaaagaaagcacgggggaatgcttgtcaggaatcctctgtcccgaaactcaacccacgagatgtattgggtgagctgcggcacaggtaatatcgtttcggcggtgaacatgacttctcggatgttactgaaccgttttaccatggctcatagaaaacccacatacgaacgcgatgtcgacttgggggcaggaaccaggcacgtggccgtagagcctgaagtggctaatctcgatataatcggccagcggattgagaacatcaagaatgaacataaaagtacttggcactatgacgaggataacccatacaagacgtgggcctatcacggctcctacgaggttaaacccagcgggtcagcatcctctatggtcaatggagtggtgagactgctaacaaagccttgggacgtcattccaatggttacccagatcgccatgactgataccacacccttcggtcaacagcgcgtgtttaaggaaaaagtagacacgaggaccccgcgagctaagcggggcactacacagattatggaggtgaccgcgaaatggctttgggggttcctgagcagaaacaagaaacctaggatctgtactcgcgaagagtttacacgtaaggtccggagtaatgccgcaataggagctgtgttcgttgacgaaaaccagtggaactccgccaaggaggcagtggaggatgaaagattttgggacctcgtccatagggagcgcgaactgcacaaacaaggcaagtgcgcaacctgcgtgtataacatgatgggtaaacgagagaagaaattgggggagttcggaaaggctaagggcagccgggccatttggtacatgtggctgggcgcgagattcctcgagtttgaggcacttgggttcatgaatgaagatcattggttttctagggagaactcactgagtggagtagaaggtgagggcttacacaaactggggtacatcttgcgcgacatctccaagattccaggaggcaatatgtatgccgatgacacagctggttgggatactagaataaccgaggacgatctccagaacgaagccaaaatcacggacattatggagcccgaacatgcactgctagctaccagcatcttcaaacttacataccagaataaagttgtgcgggtccagaggcctgccaagaacgggactgtgatggatgtgatttctcgtcgagaccaacgcggatcgggccaggtcggcacctatgggctgaacacatttactaatatggaggttcagctcatcagacagatggaatcagagggaatattcctgccaagcgagttggaaacccccaacttagctgagcgggccctggattggctcgaaaaacacggtgcagagaggcttaagcgcatggcgatctccggcgacgactgtgtggtaaagccgattgatgacagatttgccacggctctgacagccctaaatgatatggggaaagtgcggaaggacatccctcaatgggaacccagtaaaggatggaacgattggcagcaggtcccattctgctctcaccattttcaccagctgattatgaaggacggcagggagatcgtggttccttgtcgaaatcaagatgagctcgtgggtcgtgcaagagtcagccagggggctggatggtccttgcgcgaaaccgcctgcctgggcaaatcatacgcacagatgtggcaacttatgtatttccatcggagggacctgagactcgccgcgaacgctatatgtagtgccgtgcccgtagattgggttccagcatctcgcactacatggagcattcacgcccaccatcagtggatgaccactgaggacatgttatccgtgtggaatcgggtctggatcgaagagaacccctggatggaagataagacccacgtgtcaagctgggaggaggttccttacctgggcaagagggaagaccagtggtgcgggtctttgatcggactgacagctcgagccacgtgggcaaccaatattcaggtggctataaaccaagtcagacggctcatcggtaatgagaactatcttgactacatgacttccatgaaaaggtttaagaatgaaagtgatccagagggcgccctgtggtga

SEQ ID NO: 13191 - RNA, 9879 nt, synthetic construct
  misc_feature 1..9879: note = derived and/or modified CDS sequence (opt3) from DENV-1__JX669463__SS-prME
  source 1..9879: mol_type = other RNA
agcgtgaccatgctgctcatgcttctgcccaccgccttggctttccacttaactacgagaggaggggaacctcatatgatcgtctccaagcaggaaaggggaaagtctctgctatttaagacctcagccggtgttaatatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcagacgggagagcaccgccgagagaagcgtagcgtggccctggcaccccatgtcggcttgggtctcgaaactagaaccgagacatggatgtcctctgaaggggcctggaggcagatccagcgggtggagacttgggctctgcgccaccctggattcaccgttattgcatttttcctggcccatgctatcggcacatcgattacccagaaaggcatcatatttatcctcttaatgctggtgacgccatcaatggccatgagatgcgtcgggattggaaacagggacttcgtggagggtcttagcggcgcgacttgggtagatgttgtgttggaacacgggagttgtgtcacaaccatggcaaagaataagcccactctggacatcgagctactcaaaacagaagtgaccaaccctgccgtgctgcggaaactttgcattgaggctaaaatctccaatacgaccacagattctcgctgtccaactcaaggagaagccaccctggtcgaggagcaggacgcaaactttgtttgccgaagaacattcgtggataggggctggggtaatgggtgtggattgtttggcaagggcagcctcctgacttgcgctaaattcaagtgcgtaaccaagttagaagggaaaatagtgcagtacgagaacctgaagtattccgtcattgtgacagttcacaccggagaccagcatcaagtgggtaatgaaactacggagcacggcacaatcgccaccattactccccaggcgcctacctcagaaatccagctcacagattacggggcccttaccctggactgtagtccacggactggattggactttaacgagatggtcctactgacaatgaaagaaaagagctggctcgtgcataaacagtggttcctggatcttccgctgccctggacgtctggcgcatccacctcacaagaaacttggaatcgtcaggacttgctcgtaacatttaagaccgctcacgccaaaaagcaggaggttgtggtcctgggtagccaagaaggggctatgcacacagccttaactggcgcaaccgagatccagacgagtggaaccacaactattttcgccggccatctgaagtgccgcctaaaaatggataagctcaccctgaaagggatgtcttatgtgatgtgtacaggatccttcaaacttgaaaaagaggtcgctgagactcagcacggtaccgtgttggttcaggtgaagtacgaaggcacggacgcgccttgcaagataccatttagcacacaagatgagaaaggggtaacccagaacggaagactgatcactgcaaatcccattgtcacagacaaggaaaaacctgtgaacatcgagaccgagccacccttcggcgaatcgtatatagttgtgggtgccggggagaaggctctcaaactgtcttggtttaagaggggctcctcaattggaaagatgttcgaagccactgcacggggcgcccgacgcatggctatccttggggataccgcctgggactttggaagtatcggtggcgtcttcacaagcgtggggaaactggtacatcaggtgtttggaacggcatacggcgttttgttctccggtgtctcttggaccatgaagattgggatcggcattctcctgacttggttaggactgaatagcagatcaacaagtctatccatgacctgtatagcggtgggcatggtgacactctacctgggggtcatggttcaggctgatagcggatgcgtgatcaactggaaaggcagggagcttaagtgtggttctgggatttttgtgactaacgaagtacacacctggacggagcaatataaattccaggccgactcaccgaagcggttgagtgcagccatcggaaaggcttgggaggaaggcgtctgcggtatccgcagcgccacaagactggagaatattatgtggaaacagatatccaacgaactcaatcatatcctgttagagaacgatatgaagtttaccgtggttgtgggcgacgcaaatgggattctggctcagggcaagaagatgatcaggcctcaacccatggaacacaaatactcttggaagtcgtggggcaaagccaagattatcggggcggacatacagaacactaccttcatcattgatggaccagacacacctgagtgtcccgatggccagcgtgcctggaatatctgggaggtcgaagactatggttttggggtgttcactaccaacatttggcttaagttgcgggatagctacacacagatgtgcgaccaccgactcatgtccgctgcaatcaaagattcaaaggccgttcatgctgacatgggatattggatagagagtgagaagaatgagacgtggaagctggccagagcatctttcattgaagtgaaaacctgtacttggccaaagagccacacactatggtccaacggcgtactggagtcagagatgatcattcccaagatctttggtggccctataagccaacataattacaggccagggtatttcacccagactgcgggaccgtggcacctcggcaaactggaacttgattttgacttgtgcgaggggacaaccgtcgtggtggatgaacactgcggaaaccgcggcccctctctgcggacgactaccgtcacaggtaagatcattcatgagtggtgttgcagatcctgtaccttacctccactcaggttccgcggggaggacggatgctggtacggcatggaaatccgacccgttaaagagaaggaagagaatctggtgcggagtatggtaagcgccggttctggcgaagtggattccttttcacttgggattctgtgtgtcagtatcatgatagaggaggtgatgcgtagcagatggtcgaggaaaatgttgatgactggaacactcgctgttttcctgctactgattatgggccagctcacctggaacgacctgatccgcctttgcatcatggtgggggccaatgcatccgaccggatgggaatgggcacaacttacttggctctgatggccaccttaaagatgagacctatgtttgcagtcggtctcctgttcaggcgacttacgtctcgcgaagtgctgctactcacaattgggctgagcttggttgcctcagtggagctgccaaacagtttagaggaactcggagatggcctggctatgggcatcatgatgcttaagctgttgaccgaatttcaaccccaccagctctggactaccctgctatccctgacattcgtcaaaactaccctttctctcgactatgcgtggaagacgacagccatggtactgagcattgtgtccttgtttccgctgtgtttatcaaccactagccagaaaacaacctggctccctgttctgcttgggagtttcggatgcaagccactgactatgtttttgataacagagaacaaaatctggggtcggaagtcttggcccctcaatgagggcattatggcaatcgggattgtgtccatcctgctaagctcgctgcttaagaacgatgtccctctcgctggacccctgatagccggcggtatgttgatcgcctgttacgtgatttcagggtctagtgctgacttatccctggaaaaagcagccgaggtaagctgggaacaggaggcggaacattctggagctagccacaatatcctcgtggaggtccaagatgacggcaccatgaagattaaagatgaggaaagagacgatacgctgactatccttctgaaggccaccttgctagcagtttccggcgtgtatccaatgtcaatacctgccacactgttcgtgtggtacttctggcagaaaaagaaacagaggagtggggtcctctgggacacccccagcccaccggaggtggaacgtgctgttctggatgacggaatttatcgcatccttcagcggggtttactgggcagatctcaagtaggggtgggagtctttcaggatggcgtgttccatacaatgtggcacgttactaggggtgcagtgctcatgtaccaggggaagcgattggagccttcctgggcctcagtcaagaaagacctgatcagttatggaggcggctggcggtttcaggggagctggaacaccggagaggaagtgcaagtaattgcggtcgagcccggtaagaatcccaagaatgtgcagacgacacccggcactttcaagacccctgaaggggaggttggagctatagccctcgactttaaaccaggcacatccggttctcccatcgtgaatcgcgaagggaagattgtcggactgtacggcaacggcgtggttaccacttcggggacctacgtgagcgcaatcgcccaggctaaggcctcacaagagggacctcttccggagattgaagatgaggtcttcaaaaagagaaatctgacaatcatggacttgcacccaggttccggcaaaacgaggcggtatctacccgcaatagtgcgagaagctatcaagagaaaactgcgcactctcattttagcccctaccagggtagtggcgagtgagatggccgaagcactgaaggggatgccaatccgttaccagacaaccgctgttaagtctgagcatactggacgggagattgtcgatcttatgtgccacgccacatttaccatgagactgctcagccccgtgagggtgcctaactataatatgatcataatggacgaagctcatttcacggatccggcatccattgccgcccgcggctacatctcaactcgagtcggtatgggggaggctgcggcaatctttatgacagccacaccaccaggatctgtagaggctttccctcagagcaacgccgtgattcaggacgaggaaagagatatccccgagcggagttggaactccggctatgactggataaccgattttccaggcaaaactgtttggttcgtgcctagcattaagtctgggaacgacatcgcaaattgtttgaggaaaaacggaaagcgcgtcattcaactgtcacgtaaaacattcgataccgagtaccagaagacaaagaacaatgactgggactatgtggttactacggatatctccgaaatgggtgccaactttagagctgaccgggtgatagatcccaggcgctgcctcaaaccagtcattctgaaggacggcccggagcgagtgatccttgcggggcctatgcccgtaaccgtggccagtgcagctcagagacggggaaggatcggccgcaatcagaacaaagaaggtgatcaatacatttacatggggcagccactaaataacgacgaggatcacgcccattggacagaggcaaagatgctgttggacaatatcaacactcccgaaggcattatacctgccttattcgagccagaaagagagaaaagcgctgccatcgatggagaatataggctgcggggcgaggcgcgtaagacctttgttgagctcatgcgccgaggggacctgcccgtctggctttcgtacaaggtggcatctgaaggattccagtattccgatagaaggtggtgctttgacggtgagcggaataaccaggtgctggaagagaatatggatgtcgaaatttggacaaaagagggcgagcgcaagaaactcagacctaggtggttggacgcccggacctacagcgacccgctggctctacgagagttcaaggagtttgccgctgggagacgctcagttagtggagatctgatcctcgaaatcggcaaacttccacaacacctgactttaagggcacagaacgccttggacaatctggtgatgctccacaactctgagcagggtgggaaggcttatcggcatgccatggaagaactgcccgatacgattgagacccttatgctgctcgcattgatagcggtactgacaggcggagtgactttattctttctatccggcaaagggctgggaaagaccagcatcggtctcctttgtgtcacagcctcaagtgctctgttgtggatggccagcgtggaacctcactggattgcagcttccatcattctggagttctttctcatggttctgcttatccccgaaccagaccgtcagagaacccctcaagataatcagctcgcctacgtggtcataggcctgttgttcatgatcctgactgtagcagccaacgagatggggttactagagacaacgaagaaagacctgggaattggctatgtggctgcggaaaaccatcagcacgccaccatgctcgatgttgaccttcaccccgcatctgcttggactctgtacgccgtggccacaaccgtcatcaccccaatgatgaggcatacaattgagaatactacggcaaacatcagcttgaccgctatagccaatcaagcggctattctgatgggtctcgataaggggtggcctatctccaaaatggacattggcgtgccgctgcttgccttaggatgctactcacaggtcaaccccctgacactcactgcagccgtgttgatgctggttgctcactatgcaatcataggcccagggctacaggccaaggcgacccgcgaagctcagaaacggacagccgcaggaatcatgaagaatcctaccgtggatggcattgtagccatcgacctggatcccgtggtctacgacgctaagtttgagaaacaactcggtcagattatgcttctgatcttgtgtacttctcagatactgctcatgcgaacgacatgggccctgtgcgaaagtattaccttagcaactgggccacttaccacactgtgggagggatcgcctggcaagttctggaacactaccatcgctgttagcatggccaatatcttcagaggttcctatctcgcgggcgccgggctagcattttctctgatgaaatcattgggaggcgggaggcgcggaacaggcgctcagggtgagacgctgggggaaaagtggaaacggcaactcaaccagcttagcaagtccgagttcaatacctacaagagaagtggaattatggaagtggaccgttctgaggccaaagaaggcctgaagaggggtgagactacaaaacatgcagtcagccggggcaccgctaagttgcgctggtttgtggagcgaaacctggtaaaacccgaagggaaggtgatcgatctcggatgtggcagagggggatggtcatattactgcgccggcttaaagaaagttactgaggtgaagggttatacaaaagggggaccgggccacgaagaaccaatacctatggccacctacggctggaatctggtcaaacttcattccgggaaagacgtgttctttatgcccccagaaaagtgtgatacgctgctatgcgacattggagagagtagccccaaccctaccatcgaggaaggtaggacactccgggtcctgaaaatggtggagccgtggttgcgcggcaatcagttctgtattaagatcctgaacccctacatgccatctgttgtagaaactctcgagcagatgcaaagaaagcacgggggaatgcttgtgaggaatcctctgtcccgaaactcaacccacgagatgtattgggtcagctgcggcacaggtaatatagtgtcggcggttaacatgacttctcggatgttactgaaccgttttaccatggctcatagaaaacccacatacgaacgcgatgtggacttgggggcaggaaccaggcacgtcgccgtggagcctgaagtagctaatctcgatatcattggccagcggatcgagaacattaagaatgaacataaaagtacttggcactatgacgaggataacccatacaagacgtgggcctatcacggctcctacgaggtgaaacccagcgggtcagcatcctctatggttaatggagtcgtgagactgctaacaaagccttgggacgtgatcccaatggtcacccagattgccatgactgataccacacccttcggtcaacagcgcgtttttaaggaaaaagtggacacgaggaccccgcgagctaagcggggcactacacagatcatggaggtaaccgcgaaatggctttgggggttcctgagcagaaacaagaaacctaggatatgtactcgcgaagagtttacacgtaaggtgcggagtaatgccgcaattggagctgtcttcgtggacgaaaaccagtggaactccgccaaggaggcagttgaggatgaaagattttgggacctcgtgcatagggagcgcgaactgcacaaacaaggcaagtgcgcaacctgcgtctataacatgatgggtaaacgagagaagaaattgggggagttcggaaaggctaagggcagccgggccatctggtacatgtggctgggcgcgagattcctcgagtttgaggcacttgggttcatgaatgaagatcattggttttctagggagaactcactgagtggagtggaaggtgagggcttacacaaactggggtacatcttgcgcgacatttccaagataccaggaggcaatatgtatgccgatgacacagctggttgggatactagaatcaccgaggacgatctccagaacgaagccaaaattacggacatcatggagcccgaacatgcactgctagctaccagcattttcaaacttacataccagaataaagtagttcgggtgcagaggcctgccaagaacgggactgtcatggatgtgatctctcgtcgagaccaacgcggatcgggccaggtgggcacctatgggctgaacacatttactaatatggaggtccagctcataagacagatggaatcagagggaatcttcctgccaagcgagttggaaacccccaacttagctgagcgggccctggattggctcgaaaaacacggtgcagagaggcttaagcgcatggcgatttccggcgacgactgtgttgtgaagccgatcgatgacagatttgccacggctctgacagccctaaatgatatggggaaagtacggaaggacattcctcaatgggaacccagtaaaggatggaacgattggcaacaggtgccattctgctctcaccattttcaccagctgatcatgaaggacggcagggagatagtcgtgccttgtcgaaatcaagatgagctcgttggtcgtgcaagagtgagccagggggctggatggtccttgcgcgaaaccgcctgcctgggcaaatcatacgcacagatgtggcaacttatgtatttccatcggagggacctgagactcgccgcgaacgctatttgtagtgccgtccccgtggattgggtaccagcatctcgcactacatggagcatccacgcccaccatcagtggatgaccactgaggacatgttatccgtttggaatcgggtgtggatcgaagagaacccctggatggaagataagacccacgtctcaagctgggaggaggtgccttacctgggcaagagggaagaccagtggtgcgggtctttgattggactgacagctcgagccacgtgggcaaccaatatacaggttgctatcaaccaagtgagacggctcattggtaatgagaactatcttgactacatgacttccatgaaaaggtttaagaatgaaagtgatccagagggcgccctgtggtga

SEQ ID NO: 13192 - RNA, 9879 nt, synthetic construct
  misc_feature 1..9879: note = derived and/or modified CDS sequence (opt3) from DENV-1__JX669464__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagttggtgtgaacatgtgcacactcattgcaatggacctgggcgagctttgtgaagatactatgacctacaaatgcccacggataacagaggccgaaccggacgatgtagactgttggtgcaatgcgaccgatacttgggtgacatatgggacctgtagtcaaacgggagagcaccgccgagacaagcgtagcgtcgctctggccccccatgtgggcttgggtctcgagactagaaccgaaacatggatgtcctctgagggggcatggaaacagatccagaaggttgaaacttgggccctgaggcaccctggattcaccgtgattgctctgtttctcgcacatgccatcggcacatcgattacccagaagggcatcatattcatcttactgatgcttgtcacgccatcaatggctatgcggtgcgtggggattggaaaccgcgattttgtagagggtttgagcggcgccacttgggttgacgtggtcctggagcacgggagttgtgtgacaaccatggcgaaaaataagcccactctagatatcgaactcctgaaaacagaggtgaccaaccctgcagtccttagaaagctgtgcattgaagccaaaatctccaatacgaccacagactctaggtgtccaactcaaggagaggctaccttggttgaagagcaggatgccaacttcgtgtgccggcgcacatttgtagaccgaggctggggtaatgggtgtggactcttcggcaagggcagcctgttaacttgcgcaaagtttaaatgcgtgaccaagctggaggggaaaatagtccagtacgaaaacctcaagtattccgtgattgttacagtgcacaccggagatcagcatcaagtcggtaatgagactacggaacacggcacaatcgctaccattactccccaggcccctacctcagagatccagcttacagactacggggcgctgaccttggactgtagtccaagaactggactagatttcaacgaaatggtgctgctcacaatgaaagagaagagctggctggtacataaacagtggtttcttgacctgccgttgccctggacgtctggcgcctccacctcacaagagacttggaataggcaggatctcctggttacattcaagaccgcacacgctaagaaacaggaagtggtcgtgttaggtagccaagagggggccatgcacacagctctgactggcgccaccgaaatccagacgagtggaaccacaactatttttgcaggccatctaaagtgccggctcaaaatggacaagctgacccttaaagggatgtcttatgtcatgtgtacaggatccttcaagttggagaaggaagtggccgagactcagcacggtaccgttctggtgcaggtaaaatacgagggcacggatgctccttgcaagataccattcctcacacaagacgaaaaaggggtcacccagaacggacgtctgatcactgcgaatcccattgtgacagataaggagaaacctgttaacatcgaaaccgagccaccctttggcgagagctatatagtggtcggtgcaggggaaaaggcccttaagctgtcgtggttcaaaaagggctcttccattggaaaaatgtttgaggctactgcccgcggcgcaagaaggatggccatcttgggggacaccgcttgggatttcggatcaatcggtggcctctttacaagtgtggggaagctgattcatcaggtattcggaacggcctacggcgtgttatttagcggtgtttcctggaccatgaaaatcgggattggcatactgctaacttggctcggactgaattctcggagcacatcacttagtatgacctgtatcgcagtcggcatggtgacattgtacctgggggtgatggtccaggcggactccggatgcgttattaactggaagggccgagaactcaagtgtggtagcgggatcttcgtgactaacgaggtgcacacctggacggaacaatataaatttcaggctgattctccgaagcgcctgtcagccgcaatcggaaaagcctgggaggagggcgtatgcggtattagaagtgctacaaggttagaaaatataatgtggaagcagatcagcaacgagctgaattacattcttttggaaaacgacatgaaattcaccgtcgtggttggcgacgtgaatgggatcctcgcccagggaaagaaaatgattcggcctcaacccatggagcataagtattcctggaagtcttggggcaaagcaaagatcataggggctgatatccagaacactacctttattatcgacggaccagatacacctgaatgtcccgacgatcagcgcgcctggaatatttgggaggtcgaggactacggcttcggtatctttactaccaacatatggctgaaactaagagattcgcacacacagatgtgcgaccacaggctgatgagcgcggccattaaggattccaaagctgtgcatgcagacatggggtattggatcgaatcagagaagaatgaaacgtggaagctcgcccgtgctagtttcattgaggttaaaacctgtatctggccaaagtctcacactctgtggagcaacggagtgcttgaatccgagatggtaatacccaaaatctacggcggtcctatttcacaacataattatcggccaggctacttcacacagaccgccgggccgtggcacttgggaaagctggagttagattttgacctctgcgaaggcactacagtcgtggtggatgagcactgcgggtaccgaggacccagcctgagaaccacgactgtcaccggcaaaatcattcatgaatggtgttgcaggtcttgtacacttcctccactgcgcttccggggtgaggacgggtgctggtatggaatggagatcagacccgttaaggaaaaggaggaaaacttggtgaggtccatggtaagtgcaggcagcggtgagatggactctttttccctcggcatactgtgtgtgtcaattctaatcgaagaggtcatgcgcagtcgatggagccggaaaatgctgatgaccgggactctcgcggtgttcctgcttttgatcatgggacagctgacatggaatgatttaattcgtctctgcatcatggttggcgccaacgcttcggacagaatggggatgggaaccacatacctggcccttatggcaacttttaagatgaggcctatgttcgctgtgggcctgctatttcgccggctcacctccagagaggtcctgttgctgacggtgggtttatctctcgttgccagcgtggaactgccaaattcacttgaggaactgggggatggattggcaatgggcattatgatgctcaaactgctaacagacttccaaccccaccagctgtggaccactcttctcagtctgacctttataaggacatccttgtctctggattatgcctggaagactatggctatggcgttaagcatcgtctccctcttcccgctgtgtctttcaaccacgagccagaaaacaacctggctgcctgtattgctcggcagttttgggtgcaagccactgactatgttcctaattacagagaacaagatctggggacgaaaatcttggcccattaacgaaggtatcatggccgtgggcatagtttccatcctgcttagctcgctcctgaagaatgacgtgcctttggcagggcccttaattgctggaggcatgctgatcgcctgttacgtcatttcaggttctagtgccgatctctccctggagaaagctgcagaggtgagctgggaagaggaagccgagcattctgggaccagccacaacatccttgtagaagtgcaggacgatggaactatgaagataaaagacgaggagcgcgatgacacactgaccattttgctaaaggcgacgctgctcgctgtctccggcgtttatccaatgtcaatccctgccactctgtttgtgtggtacttctggcaaaaaaagaagcagcggagtggcgtgctttgggatacccccagcccaccggaagtcgagagagcagtgttagacgacgggatctataggattctgcagcgtggactcttgggtcgctctcaggttggcgtaggggtgttccaagatggagtctttcatacaatgtggcacgtgacccggggcgccgttctgatgtaccagggtaaaagactcgaaccttcctgggcttcagtgaagaaagacctgataagttacgggggaggctggaggttccagggcagctggaatacaggggaggaggtccaggtgatcgcagtagaacccggaaagaacccaaaaaatgtccaaactacccccggtacgtttaagattcctgagggcgaagtgggggccatcgcgcttgatttcaagccaggaacatccggctctcccattgttaaccgagagggtaaaatcgtggggctgtatggaaatggcgtcgtgactacctcgggcacatacgttagcgctatagcccaggcaaaggccacccaggaagggcctttgccggagatcgaggacgaagtgtttaaaaagcggaacctaactattatggatctgcacccaggatcaggtaaaacccgcagatatctccccgctatcgtcagggaggccattaagcggaagttacgaacactgatccttgcacctacgagagtggtagcttccgaaatggccgaggcgctgaaaggcatgccaatacgctaccaaactaccgccgtgaagagtgaacatacagggagggagattgttgacctcatgtgccacgcaaccttcactatgcgtttgctgtctcccgtccgggtgcctaattataacatgatcatcatggatgaggctcattttacagacccggccagcattgctgcaagaggatacatctccaccagggtgggcatgggtgaagccgccgctatattcatgacggcgactcccccagggtcagtcgaggcatttcctcagtctaatgccgtaattcaggatgaagagcgcgacatccccgaacgaagctggaacagtggatatgattggattacagacttcccaggcaaaaccgtgtggtttgttccttccatcaagagcggcaatgacatagctaactgtctcagaaaaaatgggaagcgggtgattcagctgtctaggaagaccttcgatactgagtaccaaaaaacaaagaacaacgactgggattacgtcgtgaccacagacatctcagagatgggagccaatttccgcgcagatcgtgttatcgaccccagacggtgccttaaaccagtgattctaaaggaaggtccggagagggtcatcctggccggccctatgcccgtgactgtagcttccgcggcccagcgccgagggagaattggacggaaccagaataaagaaggcgatcagtatatatacatgggtcaaccattgaacaatgacgaggatcacgcacattggacggaggctaagatgttactggacaacatcaatacccccgaagggattatccctgccctctttgagccagaaagggagaagagtgcagccatcgatggcgaatatcgcctgagaggagaggctaggaaaacattcgtggagcttatgcggcgtggcgacctgcccgtttggctcagctacaaggtcgcctcggaagggtttcagtattctgatcgccgatggtgcttcgacggagagagaaacaatcaggtgttggaagagaacatggacgtggaaatttggactaaagagggtgagaggaagaaactgcggcctcgctggctagatgcgagaacctactccgacccgctggcactcagggaatttaaggagttcgccgctggccggcgaagcgtctcaggggatcttatactggaaatcggaaaattaccacagcacttgacactgagagcccaaaatgctctcgacaacctggttatgcttcacaatagtgagcagggcggtaaggcatatcgccatgccatggaagagctgcccgataccattgagactctcatgttgctggctttaatcgccgtgctaacggggggcgtaaccctgtttttcctctctggaaagggccttgggaaaacatccattggactgttgtgtgtgatggcaagctcagcgctgctctggatggccagtgtcgaacctcactggatcgctgccagcataatcctggagtttttccttatggtgctcctgattcccgaaccagacaggcagcggactcctcaggataaccaattggcatacgttgtgatcggtctgttatttatgattctaaccgtcgctgccaatgagatgggcctgctcgagacaaccaagaaagaccttgggatcggacatgtagcagtggaaaaccaccaccatgccactatgctggatgttgacttgcgtcccgcttccgcgtggacactgtacgccgtggcaacgaccgtcataactccaatgatgagacacacaattgagaacaccaccgctaatatctctctcacagccattgccaaccaggcagctatcctgatgggccttgataagggttggcctataagcaaaatggacatcggggtgccgttactggccctcggctgctattcccaggtcaatcccttgactctgacggcggctgtgctaatgctggttgcccattacgcaattatcggaccaggcctccaagccaaggctaccagggaagcacagaagcgcacagccgcggggattatgaaaaaccctactgtggatggaatcgtaaccatagaccttgaccccgtggtctatgatgctaagttcgagaaacagctgggccagattatgttgctgatcctctgtacatcacaaatcctgttaatgcggaccacttgggccctttgcgaatctattacgctggcaacaggtccactcaccactctatgggaggggagtcctggaaagttttggaataccacaatcgccgtttcgatggctaacatattccgaggcagctacctggccggtgcaggcttggctttctccctgatgaaatctctcgggggaggcagaagggggactggagcccagggcgagacccttggtgaaaagtggaagcgccagctgaatcagttgtcaaaaagcgagtttaacacatataagaaatccgggattatggaagtggaccggagtgaggcgaaggaaggactgaaaagaggcgagacgaccaagcacgccgtctctcgtggtactgcaaagctcaggtggttcgtggagcggaatttagtaaaacccgaaggcaaggtgatcgatctggggtgtggacgcggcgggtggagctactattgcgctggacttaaaaaggttacagaggtgaaaggctacaccaagggtgggccgggacatgaagagccaattcctatggccacttacggctggaacctggtcaaactacactcaggcaaggacgtgtttttcacacccccagaaaagtgtgataccctcctgtgcgacatcggggagtccagtcccaatcctacgatagaggaaggacgaaccttgagagtcctgaaaatggtggagccgtggctcaggggtaaccaattttgtatcaagattcttaatccctatatgccaagcgttgtagaaacactggagcagatgcagcggaaacacggcgggatgttagtgcgcaaccctctgtctagaaattccactcatgagatgtactgggtctcatgcggaaccggcaacatcgtgagcgcagttaatatgacatcgaggatgttgctcaaccgattcactatggctcaccggaagcccacctatgaacgtgatgtggacctgggtgccgggacaagacatgtcgccgtggagcctgaagtagcgaacctagatattatcggacagcgcattgagaatatcaaaaacgaacacaagtctacctggcactacgacgaggataatccatataagacttgggcttaccatggcagttatgaggtgaaaccctccggcagcgcatcatccatggttaacggggtcgtgaggcttctgacgaagccttgggacgtgataccaatggtcacacaaattgccatgaccgacactaccccctttggacagcagcgggttttcaaagaaaaggtggatacaagaacgccgcgcgctaaaaggggtaccgcccaaatcatggaggtaactgcaaagtggctctggggctttctgtctcgaaataagaaacctcggatctgtacaagagaagagttcaccaggaaggtgcgcagcaacgccgctattggggcggtctttgtggacgaaaatcagtggaacagtgccaaagaggcagttgaggatgaacgtttctgggacttggtgcaccgggagagagaactgcataagcagggaaaatgcgctacttgcgtctacaatatgatgggcaagagggagaagaaactcggtgaatttgggaaggccaaaggatcccgcgcaatatggtacatgtggcttggcgcccgattcctggagttcgaggctttaggctttatgaacgaagatcactggttcagccgggagaattctctgtcaggggtggaaggagagggtttgcataagctcggctatatcctgagagacattagtaaaatcccagggggaaacatgtacgccgatgacacagcgggctgggataccaggattacagaggacgatctacagaatgaagcaaagatcactgacataatggagcccgaacacgcccttctggctacctccatctttaaactcacgtatcaaaacaaggtagttcgcgtgcagagacctgccaagagcggtaccgtcatggatgtgatttctcggagggaccagcgtgggtcgggacaggtgggcacatacggcctgaatactttcaccaacatggaggtccaattgatccgacagatggaatcagaggggatttttttaccaagcgagctggaaacacccaacctcgcaaaaaaggttcttgactggctggagaaacacggagctgaacgcctaaagagaatggccatctccggtgatgactgtgtggtaaaaccgatagatgaccggttcgctactgccctgaccgcactcaatgatatgggcaaggtgaggaaggacattcctcagtgggagcccagtaaagggtggaacgattggcagcaagtcccattttgctctcatcacttccatcagttgatcatgaaggacggacgcgaaatcgtggttccttgtagaaatcaggatgagctggtgggccgggcgagggtcagccagggtgccgggtggtcccttcgagagacggcttgcctgggaaaatcatatgcccaaatgtggcagctcatgtactttcaccgtagagacttacgcctggcagctaacgccatttgtagtgcagtgcccgtagattgggttccaacatctcggaccacttggagcatacacgcccatcaccagtggatgacaaccgaagacatgttgtccgtgtggaatagggtctggatcgaggaaaacccctggatggaggacaagactcatgtgtcaagctgggaagaggttccttatctgggcaaaagagaggatcaatggtgcggctctctcattgggcttaccgcgcgcgctacatgggccacgaatatccaggtggcaattaaccaggtccggaggctgatcggaaatgaaaactacctagactacatgacctccatgaagcgattcaagaatgagagtgatccagaaggtgccctgtggtga

SEQ ID NO: 13193 - RNA, 9879 nt, synthetic construct
  misc_feature 1..9879: note = derived and/or modified CDS sequence (opt3) from DENV-1__JX669465__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagttggtgtgaacatgtgcacactcattgcaatggacctgggcgagctttgtgaagatactatgacctacaaatgcccacggataacagaggccgaaccggacgatgtagactgttggtgcaatgcgaccgatacttgggtgacatatgggacctgtagtcaaacgggagagcaccgccgagacaagcgtagcgtcgctctggccccccatgtgggcttgggtctcgagactagaaccgaaacatggatgtcctctgagggggcatggaaacagatccagaaggttgaaacttgggccctgaggcaccctggattcaccgtgattgctctgtttctcgcacatgccatcggcacatcgattacccagaagggcatcatattcatcttactgatgcttgtcacgccatcaatggctatgcggtgcgtggggattggaaaccgcgattttgtagagggtttgagcggcgccacttgggttgacgtggtcctggagcacgggagttgtgtgacaaccatggcgaaaaataagcccactctagatatcgaactcctgaaaacagaggtgaccaaccctgcagtccttagaaagctgtgcattgaagccaaaatctccaatacgaccacagactctaggtgtccaactcaaggagaggctaccttggttgaagagcaggatgccaacttcgtgtgccggcgcacatttgtagaccgaggctggggtaatgggtgtggactcttcggcaagggcagcctgttaacttgcgcaaagtttaaatgcgtgaccaagctggaggggaaaatagtccagtacgaaaacctcaagtattccgtgattgttacagtgcacaccggagatcagcatcaagtcggtaatgagactacggaacacggcacaatcgctaccattactccccaggcccctacctcagagatccagcttacagactacggggcgctgaccttggactgtagtccaagaactggactagatttcaacgaaatggtgctgctcacaatgaaagagaagagctggctggtacataaacagtggtttcttgacctgccgttgccctggacgtctggcgcctccacctcacaagagacttggaataggcaggatctcctggttacattcaagaccgcacacgctaagaaacaggaagtggtcgtgttaggtagccaagagggggccatgcacacagctctgactggcgccaccgaaatccagacgagtggaaccacaactatttttgcaggccatctaaagtgccggctcaaaatggacaagctgacccttaaagggatgtcttatgtcatgtgtacaggatccttcaagttggagaaggaagtggccgagactcagcacggtaccgttctggtgcaggtaaaatacgagggcacggatgctccttgcaagataccattcctcacacaagacgaaaaaggggtcacccagaacggacgtctgatcactgcgaatcccattgtgacagataaggagaaacctgttaacatcgaaaccgagccaccctttggcgagagctatatagtggtcggtgcaggggaaaaggcccttaagctgtcgtggttcaaaaagggctcttccattggaaaaatgtttgaggctactgcccgcggcgcaagaaggatggccatcttgggggacaccgcttgggatttcggatcaatcggtggcctctttacaagtgtggggaagctgattcatcaggtattcggaacggcctacggcgtgttatttagcggtgtttcctggaccatgaaaatcgggattggcatactgctaacttggctcggactgaattctcggagcacatcacttagtatgacctgtatcgcagtcggcatggtgacattgtacctgggggtgatggtccaggcggactccggatgcgttattaactggaagggccgagaactcaagtgtggtagcgggatcttcgtgactaacgaggtgcacacctggacggaacaatataaatttcaggctgattctccgaagcgcctgtcagccgcaatcggaaaagcctgggaggagggcgtatgcggtattagaagtgctacaaggttagaaaatataatgtggaagcagatcagcaacgagctgaattacattcttttggaaaacgacatgaaattcaccgtcgtggttggcgacgtgaatgggatcctcgcccagggaaagaaaatgattcggcctcaacccatggagcataagtattcctggaagtcttggggcaaagcaaagatcataggggctgatactcagaacaccacatttatcattgacggaccagatactcctgaatgtcccgacgatcagcgcgcctggaatatctgggaggtcgaggactacggcttcggtatttttaccacaaacatctggctgaaactaagagattcgcacacgcagatgtgcgaccacaggctgatgagcgcggccataaaggattccaaagctgtgcatgcagacatggggtattggattgaatcagagaagaatgaaacctggaagctcgcccgtgctagtttcatcgaggttaaaacttgtatttggccaaagtctcacacactgtggagcaacggagtgcttgaatccgagatggtaatccccaaaacctacggcggtcctatatcacaacataattatcggccaggctacttcactcagacagccgggccgtggcacttgggaaagctggagttagattttgacctctgcgaaggcaccacggtcgtggtggatgagcactgcgggtaccgaggacccagcctgagaactaccacagtcaccggcaaaatcattcatgaatggtgttgcaggtcttgtactcttcctccactgcgcttccggggtgaggacgggtgctggtatggaatggagatcagacccgttaaggaaaaggaggaaaacttggtgaggtccatggtaagtgcaggcagcggtgagatggactctttttccctcggcattctgtgtgtgtcaatcctaatagaagaggtcatgcgcagtcgatggagccggaaaatgctgatgacagggaccctcgcggtgttcctgcttttgattatgggacagctgacatggaatgatttaatccgtctctgcatcatggttggcgccaacgcttcggacagaatggggatgggaactacctacctggcccttatggcaacgtttaagatgaggcctatgttcgctgtgggcctgctatttcgccggctcacatccagagaggtcctgttgctgaccgtgggtttatctctcgttgccagcgtggaactgccaaattcacttgaggaactgggggatggattggcaatgggcattatgatgctcaaactgctaactgacttccaaccccaccagctgtggaccacacttctcagtctgacttttatcaggacctccttgtctctggattatgcctggaagacgatggctatggcgttaagcattgtctccctcttcccgctgtgtctttcaacaaccagccagaaaactacatggctgcctgtattgctcggcagttttgggtgcaagccactgaccatgttcctaataactgagaacaagatctggggacgaaaatcttggcccattaacgaaggtatcatggccgtgggcattgtttccatcctgcttagctcgctcctgaagaatgacgtgcctttggcagggcccttaatagctggaggcatgctgatcgcctgttacgtcatttcaggttctagtgccgatctctccctggagaaagctgcagaggtgagctgggaagaggaagccgagcattctgggacaagccacaacatccttgtagaagtgcaggacgatggaaccatgaagattaaagacgaggagcgcgatgacacgctgactatcttgctaaaggcgaccctgctcgctgtctccggcgtttatccaatgtcaatacctgccacactgtttgtgtggtacttctggcaaaaaaagaagcagcggagtggcgtgctttgggatacccccagcccaccggaagtcgagagagcagtgttagacgacgggatttataggatcctgcagcgtggactcttgggtcgctctcaggttggcgtaggggtgttccaagatggagtctttcatacaatgtggcacgtgactcggggcgccgttctgatgtaccagggtaaaagactcgaaccttcctgggcttcagtgaagaaagacctgatcagttacgggggaggctggaggttccagggcagctggaataccggggaggaggtccaggtgattgcagtagaacccggaaagaacccaaaaaatgtccaaacgacacccggtacttttaagacccctgagggcgaagtgggggccatagcgcttgatttcaagccaggaacatccggctctcccatcgttaaccgagagggtaaaattgtggggctgtatggaaatggcgtcgtgaccacttcgggcacctacgttagcgctatcgcccaggcaaaggccacacaggaagggcctttgccggagattgaggacgaagtgtttaaaaagcggaacctaacgatcatggatctgcacccaggatcaggtaaaactcgcagatatctccccgctatagtcagggaggccatcaagcggaagttacgaaccctgattcttgcacctacaagagtggtagcttccgaaatggccgaggcgctgaaaggcatgccaatccgctaccaaaccactgccgtgaagagtgaacatacagggagggagattgttgacctcatgtgccacgcaaccttcacgatgcgtttgctgtctcccgtccgggtgcctaattataacatgatcataatggatgaggctcattttactgacccggccagcattgctgcaagaggatacatctccacaagggtgggcatgggtgaagccgccgctatcttcatgaccgcgacccccccagggtcagtcgaggcatttcctcagtctaatgccgtaattcaggatgaagagcgcgacatccccgaacgaagctggaacagtggatatgattggataactgacttcccaggcaaaacagtgtggtttgttccttccattaagagcggcaatgacatcgctaactgtctcagaaaaaatgggaagcgggtgattcagctgtctaggaagaccttcgatacagagtaccaaaaaactaagaacaacgactgggattacgtcgtgacgaccgacatctcagagatgggagccaatttccgcgcagatcgtgttatagaccccagacggtgccttaaaccagtgattctaaaggaaggtccggagagggtcatcctggccggccctatgcccgtgacagtagcttccgcggcccagcgccgagggagaatcggacggaaccagaataaagaaggcgatcagtatatttacatgggtcaaccattgaacaatgacgaggatcacgcacattggactgaggctaagatgttactggacaacatcaatacccccgaagggattatacctgccctctttgagccagaaagggagaagagtgcagccatcgatggcgaatatcgcctgagaggagaggctaggaaaacattcgtggagcttatgcggcgtggcgacctgcccgtttggctcagctacaaggtcgcctcggaagggtttcagtattctgatcgccgatggtgcttcgacggagagagaaacaatcaggtgttggaagagaacatggacgtggaaatttggaccaaagagggtgagaggaagaaactgcggcctcgctggctagatgcgagaacttactccgacccgctggcactcagggaatttaaggagttcgccgctggccggcgaagcgtctcaggggatcttatcctggaaatcggaaaattaccacagcacttgacgctgagagcccaaaatgctctcgacaacctggttatgcttcacaatagtgagcagggcggtaaggcatatcgccatgccatggaagagctgcccgataccattgagacactcatgttgctggctttaatagccgtgctaactgggggcgtaaccctgtttttcctctctggaaagggccttgggaaaacatccatcggactgttgtgtgtgatggcaagctcagcgctgctctggatggccagtgtcgaacctcactggattgctgccagcatcattctggagtttttccttatggtgctcctgatccccgaaccagacaggcagcggacccctcaggataaccaattggcatacgttgtgataggtctgttatttatgatcctaactgtcgctgccaatgagatgggcctgctcgagacaacgaagaaagaccttgggattggacatgtagcagtggaaaaccaccaccatgccaccatgctggatgttgacttgcgtcccgcttccgcgtggactctgtacgccgtggcaacaaccgtcatcaccccaatgatgagacacacaattgagaacactacggctaatatctctctcaccgccatagccaaccaggcagctattctgatgggccttgataagggttggcctatcagcaaaatggacattggggtgccgttactggccctcggctgctattcccaggtcaatcccttgacactgactgcggctgtgctaatgctggttgcccattacgcaatcataggaccaggcctccaagccaaggctaccagggaagcacagaagcgcacagccgcggggatcatgaaaaaccctaccgtggatggaattgtaactatcgaccttgaccccgtggtctatgatgctaagttcgagaaacagctgggccagattatgttgctgatcctctgtacgtcacaaatactgttaatgcggacaacctgggccctttgcgaatctattactctggcaaccggtccactcacaactctatgggaggggagtcctggaaagttttggaataccacaatcgccgtttcgatggctaacatcttccgaggcagctacctggccggtgcaggcttggctttctccctgatgaaatctctcgggggaggcagaagggggacgggagcccagggcgagacccttggtgaaaagtggaagcgccagctgaatcagttgtcaaaaagcgagtttaacacttataagaaatccgggattatggaagtggaccggagtgaggcgaaggaaggactgaaaagaggcgagacaaccaagcacgccgtctctcgtggtactgcaaagctcaggtggttcgtggagcggaatttagtaaaacccgaaggcaaggtgatcgatctggggtgtggacgcggcgggtggagctactattgcgctggacttaaaaaggttacagaggtgaaaggctacaccaagggtgggccgggacatgaagagccaatacctatggccacgtacggctggaacctggtcaaactacactcaggcaaggacgtgtttttcacccccccagaaaagtgtgatacactcctgtgcgacattggggagtccagtcccaatcctactatcgaggaaggacgaaccttgagagtcctgaaaatggtggagccgtggctcaggggtaaccaattttgtattaagatccttaatccctatatgccaagcgttgtagaaacactggagcagatgcagcggaaacacggcgggatgttagtgcgcaaccctctgtctagaaattccactcatgagatgtactgggtctcatgcggaaccggcaacatagtgagcgcagttaatatgacatcgaggatgttgctcaaccgattcaccatggctcaccggaagcccacttatgaacgtgatgtggacctgggtgccgggacgagacatgtcgccgtggagcctgaagtagcgaacctagatatcattggacagcgcatcgagaatattaaaaacgaacacaagtctacatggcactacgacgaggataatccatataagacctgggcttaccatggcagttatgaggtgaaaccctccggcagcgcatcatccatggttaacggggtcgtgaggcttctgactaagccttgggacgtgatcccaatggtcacccaaattgccatgacagacacgaccccctttggacagcagcgggttttcaaagaaaaggtggatactagaacaccgcgcgctaaaaggggtaccgcccaaatcatggaggtaactgcaaagtggctctggggctttctgtctcgaaataagaaacctcggatatgtacaagagaagagttcaccaggaaggtgcgcagcaacgccgctattggggcggtctttgtggacgaaaatcagtggaacagtgccaaagaggcagttgaggatgaacgtttctgggacttggtgcaccgggagagagaactgcataagcagggaaaatgcgctacatgcgtctacaatatgatgggcaagagggagaagaaactcggtgaatttgggaaggccaaaggatcccgcgcaatctggtacatgtggcttggcgcccgattcctggagttcgaggctttaggctttatgaacgaagatcactggttcagccgggagaattctctgtcaggggtggaaggagagggtttgcataagctcggctatatcctgagagacattagtaaaataccagggggaaacatgtacgccgatgacactgcgggctgggataccaggatcacggaggacgatctacagaatgaagcaaagattaccgacatcatggagcccgaacacgcccttctggctacatccatttttaaactcacttatcaaaacaaggtagttcgcgtgcagagacctgccaagagcggtaccgtcatggatgtgatctctcggagggaccagcgtgggtcgggacaggtgggcacatacggcctgaatactttcaccaacatggaggtccaattgatacgacagatggaatcagaggggatctttagcccatccgagttagaaacgcccaacctggcaaaaaaggttctcgactggcttgagaaacacggagctgaacgcctgaagagaatggccattagtggtgatgactgtgtggtaaaaccgatcgatgaccggttcgctacagccctaaccgcactgaatgatatgggcaagattaggaaggacatccctcagtgggagccctctaaagggtggaacgattggcagcaagtgccattttgcagccatcacttccatcagctcataatgaaggacggacgcgaaattgtcgtgccttgtagaaatcaggatgagttggttggccgggcgagggtgtcccagggtgccgggtggtcactgcgagagactgcttgccttggaaaaagttatgcccaaatgtggcagctgatgtactttcaccgtagagacctccgcttagcagctaacgccatctgttctgcagtccccgtggattgggtaccaacaagccggaccacttggtccatccacgcccatcaccagtggatgaccacagaagacatgctgtcagtttggaatagggtgtggattgaggaaaacccctggatggaggacaagacgcatgtcagctcttgggaagaggtgccttatttgggcaaaagagaggatcaatggtgcggctccctgatagggctcaccgcgcgcgctacttgggccacaaatatccaggttgcaattaaccaggtgcggaggcttatcggaaatgaaaactacctggactacatgaccagtatgaagcgattcaagaatgagagcgatccagaaggtgccctatggtga

SEQ ID NO: 13194 - RNA, 9879 nt, synthetic construct
  misc_feature 1..9879: note = derived and/or modified CDS sequence (opt3) from DENV-1__JX669466__SS-prME
  source 1..9879: mol_type = other RNA
agcgtgaccatgctgctcatgcttctgcccaccgccttggctttccacttaactacgagaggaggggaacctcatatgatcgtatccaagcaggaaaggggaaagtctctgctatttaagacctcagccggtgttaacatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcagacgggagagcaccgccgagagaagcgtagcgtggccctggcaccccatgtcggcttgggtctcgaaactagaaccgagacatggatgtcctctgaaggggcctggaggcagatccagcgggtggagacttgggctctgcgccaccctggattcaccgttattgcatttttcctggcccatgctatcggcacatcgattacccagaaaggcatcatatttatcctcttaatgctggtgacgccatcaatggccatgagatgcgtcgggattggaaacagggacttcgtggagggtcttagcggcgcgacttgggtagatgttgtgttggaacacgggagttgtgtcacaaccatggcaaagaataagcccactctggacatcgagctactcaaaacagaagtgaccaaccctgccgtgctgcggaaactttgcattgaggctaaaatctccaatacgaccacagattctcgctgtccaactcaaggagaagccaccctggtcgaggagcaggacgcaaactttgtttgccgaagaacattcgtggataggggctggggtaatgggtgtggattgtttggcaagggcagcctcctgacttgcgctaaattcaagtgcgtaaccaagttagaagggaaaatagtgcagtacgagaacctgaagtattccgtcattgtgacagttcacaccggagaccagcatcaagtgggtaatgaaactacggagcacggcacaatcgccaccattactccccaggcgcctacctcagaaatccagctcacagattacggggcccttaccctggactgtagtccacggactggattggactttaacgagatggtcctactgacaatgaaagaaaagagctggctcgtgcataaacagtggttcctggatcttccgctgccctggacgtctggcgcatccacctcacaagaaacttggaatcgtcaggacttgctcgtaacatttaagaccgctcacgccaaaaagcaggaggttgtggtcctgggtagccaagaaggggctatgcacacagccttaactggcgcaaccgagatccagacgagtggaaccacaactattttcgccggccatctgaagtgccgcctaaaaatggataagctcaccctgaaagggatgtcttatgtgatgtgtacaggatccttcaaacttgaaaaagaggtcgctgagactcagcacggtaccatattggtgcaggttaagtacgaaggcacggacgcgccttgcaagatcccatttagcacacaagatgagaaaggggtgacccagaacggaagactgattactgcaaatcccatcgtaacagacaaggaaaaacctgtcaacatagagaccgagccacccttcggcgaatcgtatattgtggttggtgccggggagaaggctctcaaactgtcttggtttaagaggggctcctcaatcggaaagatgttcgaagccactgcacggggcgcccgacgcatggctatccttggggataccgcctgggactttggaagtattggtggcgtgttcacaagcgtcgggaaactggtgcatcaggtatttggaacggcatacggcgtgttgttctccggtgtttcttggaccatgaagatcgggattggcatactcctgacttggttaggactgaatagcagatcaacaagtctatccatgacctgtatcgcggtcggcatggtgacactctacctgggggtgatggtccaggctgatcttggatgcgttattaactggaaaggcagggagttgaagtgtggtagcgggatctttgtgactaacgaagtgcacacctggacggagcaatataaattccaggccgactctccgaagcggctgtcagcagccatcggaaaggcttgggaggaaggcgtatgcggtattcgcagtgccacaagactcgagaatataatgtggaaacagatcagcaacgaactgaatcatattttactggagaacgatatgaagtttaccgtcgtggttggcgacgcaaatgggatccttgctcagggcaagaagatgattaggcctcaacccatggaacacaaatactcctggaagtcttggggcaaagccaagatcataggggcggacatccagaacactaccttcattatcgatggaccagacacacctgagtgtcccgatggccagcgtgcctggaatatttgggaggtggaagactatggttttggggtcttcactaccaacatctggttgaagctccgggattcgtacacacagatgtgcgaccaccgactgatgagcgctgcaataaaagattccaaggccgtgcatgctgacatgggatattggattgagtcagagaagaatgagacgtggaagctagccagagcaagtttcatcgaagttaaaacctgtacttggccaaagtctcacacactgtggagcaacggcgtgctcgagtccgagatgattatccccaagatatttggtggccctatctcacaacataattacaggccagggtatttcacccagactgcgggaccgtggcacctgggcaaacttgaattggattttgacctgtgcgaggggacaaccgtagtcgtggatgaacactgcggaaaccgcggccccagcttacggacgactaccgtgacaggtaagattatccatgagtggtgttgcagatcttgtaccctccctccactgaggttccgcggggaggacggatgctggtacggcatggaaattcgacccgtcaaagagaaggaagagaatcttgttcggtccatggtgagtgccggtagcggcgaagtagattctttttccctggggatcttgtgtgtgtcaataatgattgaggaggtcatgcgtagtagatggagcaggaaaatgctcatgactggaacactggctgtgttcctactgctcatcatgggccagctgacctggaacgaccttatccgcttgtgcattatggttggggccaatgcatcggaccggatgggaatgggcacaacttacctggctttaatggccacctttaagatgagacctatgttcgcagtgggtctcctgtttaggcgacttacgtcccgcgaagtcctgctactcacaatcgggctgtctttggtggccagcgttgagctgccaaactcattagaggaactcggagatggcctggctatgggcattatgatgcttaagctgttgaccgagttccaaccccaccagctctggactaccctgctaagtctgacatttgtgaaaactaccctttccctcgactatgcgtggaagacgacagccatggtcctgtctatagtcagcttgttcccgctgtgtttatccaccacttcacagaaaacaacctggctccctgtgctgcttgggagctttggatgcaagccactgactatgttcttgatcacagagaacaaaatttggggtcggaagagttggcccctcaatgagggcatcatggcaattgggatcgtttctatactgctatccagcctgcttaagaacgatgtgcctctcgctggacccctgatcgccggcggtatgttgattgcctgttacgtcatctcggggtcatctgctgacttaagtctggaaaaagcagccgaggtgtcctgggaacaggaggcggaacatagcggagcttctcacaatattctcgtagaggtgcaagatgacggcaccatgaagatcaaagatgaggaaagagacgatacgctgactatacttctgaaggccaccttgctagcagtcagcggcgtttatccaatgtccattcctgccacactgttcgtgtggtacttttggcagaaaaagaaacagaggtcaggggtgctctgggacacccccagtccaccggaggtcgaacgtgctgtgctggatgacggaatctatcgcatccttcagcggggtttactgggcagaagccaagttggggtaggagtgttccaggatggcgtctttcatacaatgtggcacgtgactaggggtgcagttctcatgtaccaggggaagcgattggagccttcttgggcctccgtgaagaaagacctgatttcatatggaggcggctggcggttccaggggagttggaacaccggagaggaagtccaagtgatagcggtagagcccggtaagaatcccaagaacgtccagacgacacccggcacttttaagacccctgaaggggaggtgggagctatcgccctcgacttcaaaccaggcacaagcggttcccccattgttaatcgcgaagggaagatcgtgggactgtacggcaacggcgtcgtgaccacttctgggacctacgtttcggcaattgcccaggctaaggccagccaagagggacctcttccggagatcgaagatgaggtgtttaaaaagagaaatctgacaataatggacttgcacccaggttcaggcaaaacgaggcggtatctacccgcaatcgtccgagaagctattaagagaaaactgcgcactctcatcttagcccctaccagggtggtagcgtccgagatggccgaagcactgaaggggatgccaattcgttaccagacaaccgctgtgaagagtgagcatactggacgggagatcgttgatcttatgtgccacgccacattcaccatgagactgctctctcccgtcagggtgcctaactataatatgataattatggacgaagctcattttacggatccggcaagcatcgccgcccgcggctacatctccactcgagtgggtatgggggaggctgcggcaattttcatgacagccacaccaccaggatcagtcgaggcttttcctcagtctaacgccgtaatccaggacgaggaaagagatatacccgagcggagctggaatagtggctatgactggattaccgatttcccaggcaaaactgtgtggttcgttccttccatcaagagcgggaacgacattgcaaattgtttgaggaaaaacggaaagcgcgtgatccaactgtctcgtaaaacatttgataccgagtaccagaagacaaagaacaatgactgggactatgtcgtgactacggatatatcagaaatgggtgccaacttcagagctgaccgggttattgatcccaggcgctgcctcaaaccagtgatcctgaaggacggcccggagcgagtcatccttgcggggcctatgcccgtgaccgtagcctccgcagctcagagacggggaaggattggccgcaatcagaacaaagaaggtgatcaatacgtgtacatggggcagccactaaataacgacgaggatcacgcccattggacagaggcaaagatgctgttggacaatatcaacactcccgaaggcattatacctgccttatttgagccagaaagagagaaaagtgctgccatcgatggagaatataggctgcggggcgaggcgcgtaagaccttcgttgagctcatgcgccgaggggacctgcccgtctggcttagctacaaggtggcatcggaaggatttcagtattctgatagaaggtggtgcttcgacggtgagcggaataaccaggtgctggaagagaatatggatgtcgaaatttggacaaaagagggcgagcgcaagaaactcagacctaggtggttggacgcccggacctactccgacccgctggctctacgagaatttaaggagttcgccgctgggagacgcagcgtttcaggagatctgatcctcgaaatcggcaaacttccacaacacctgactttaagggcacagaacgccttggacaatctggtgatgctccacaacagtgagcagggtgggaaggcttatcggcatgccatggaagaactgcccgatacgattgagacccttatgctgctcgcattgatagcggtactgacaggcggagtgactttatttttcctatctggcaaagggctgggaaagacctccatcggtctcctttgtgtcacagccagctcagctctgttgtggatggccagtgtggaacctcactggattgcagctagcatcattctggagtttttcctcatggttctgcttatccccgaaccagaccgtcagagaacccctcaagataatcagctcgcctacgtggtcataggcctgttgtttatgatcctgactgtagcagccaacgagatggggttactagagacaacgaagaaagacctgggaattggctatgtggctgcggaaaaccatcagcacgccaccatgctcgatgttgaccttcaccccgcatccgcttggactctgtacgccgtggccacaaccgtcatcaccccaatgatgaggcatacaattgagaatactacggcaaacatctctttgaccgctatagccaatcaagcggctattctgatgggtctcgataaggggtggcctatcagcaaaatggacattggcgtgccgctgcttgccttaggatgctactcccaggtcaaccccctgacactcactgcagccgtgttgatgctggttgctcactatgcaatcataggcccagggctacaggccaaggcgacccgcgaagctcagaaacggacagccgcaggaatcatgaagaatcctaccgtggatggcattgtagccatcgacctggatcccgtggtctacgacgctaagttcgagaaacaactcggtcagattatgcttctgatcttgtgtacttcacagatactgctcatgcgaacgacatgggccctgtgcgaatctattaccttagcaactgggccacttaccacactgtgggagggaagtcctggcaagttctggaacactaccatcgctgtttcgatggccaatatctttagaggtagctatctcgcgggcgccgggctagcattctccctgatgaaatctttgggaggcgggaggcgcggaacaggcgctcagggtgagacgctgggggaaaagtggaaacggcaactcaaccagctttcaaagagcgagtttaatacctacaagagatccggaattatggaagtggaccgtagtgaggccaaagaaggcctgaagaggggtgagactacaaaacatgcagtctctcggggcaccgctaagttgcgctggttcgtggagcgaaacctggtaaaacccgaagggaaggtgatcgatctcggatgtggcagagggggatggagctattactgcgccggcttaaagaaagttactgaggtgaagggttatacaaaagggggaccgggccacgaagaaccaatacctatggccacctacggctggaatctggtcaaacttcattcagggaaagacgtgtttttcatgcccccagaaaagtgtgatacgctgctatgcgacattggagagtccagtcccaaccctaccatcgaggaaggtaggacactccgggtcctgaaaatggtggagccgtggttgcgcggcaatcagttttgtattaagatcctgaacccctacatgccaagcgttgtagaaactctcgagcagatgcaaagaaagcacgggggaatgcttgtgaggaatcctctgtctcgaaactccacccacgagatgtattgggtctcatgcggcacaggtaatatagtgagcgcggttaacatgacttcgcggatgttactgaaccgtttcaccatggctcatagaaaacccacatacgaacgcgatgtggacttgggggcaggaaccaggcacgtcgccgtggagcctgaagtagctaatctcgatatcattggccagcggatcgagaacattaagaatgaacataaatctacttggcactatgacgaggataacccatacaagacgtgggcctatcacggcagttacgaggtgaaaccctccgggagcgcatcatccatggttaatggagtcgtgagactgctaacaaagccttgggacgtgatcccaatggtcacccagattgccatgactgataccacaccctttggtcaacagcgcgttttcaaggaaaaagtggacacgaggaccccgcgagctaagcggggcactacacagatcatggaggtaaccgcgaaatggctttgggggtttctgtctagaaacaagaaacctaggatatgtactcgcgaagagttcacacgtaaggtgcggagcaatgccgcaattggagctgtctttgtggacgaaaaccagtggaatagtgccaaggaggcagttgaggatgaaagattctgggacctcgtgcatagggagcgcgaactgcacaaacaaggcaagtgcgcaacctgcgtctataacatgatgggtaaacgagagaagaaattgggggagttcggaaaggctaagggctcccgggccatctggtacatgtggctgggcgcgagatttctcgagttcgaggcacttgggtttatgaatgaagatcattggttcagcagggagaactctctgtcaggagtggaaggtgagggcttacacaaactggggtacatcttgcgcgacattagtaagataccaggaggcaatatgtatgccgatgacacagctggttgggatactagaatcaccgaggacgatctccagaacgaagccaaaattacggacatcatggagcccgaacatgcactgctagctacctccatttttaaacttacataccagaataaagtagttcgggtgcagaggcctgccaagaacgggactgtcatggatgtgatcagccgtcgagaccaacgcggatctggccaggtgggcacctatgggctgaacacattcactaatatggaggtccagctcataagacagatggaatcggagggaatctttctgccatcagagttggaaacccccaacttagctgagcgggccctggattggctcgaaaaacacggtgcagagaggcttaagcgcatggcgattagcggcgacgactgtgttgtgaagccgatcgatgacagattcgccacggctctgacagccctaaatgatatggggaaagtacggaaggacattcctcaatgggaaccctccaaaggatggaacgattggcaacaggtgccattttgcagtcaccatttccaccagctgatcatgaaggacggcagggagatagtcgtgccttgtcgaaatcaagatgagctcgttggtcgtgcaagagtgtctcagggggctggatggagcttgcgcgaaaccgcctgcctgggcaaatcctacgcacagatgtggcaacttatgtattttcatcggagggacctgagactcgccgcgaacgctatttgttcagccgtccccgtggattgggtaccagcaagtcgcactacatggtctatccacgcccaccatcagtggatgaccactgaggacatgttaagcgtttggaatcgggtgtggatcgaagagaacccctggatggaagataagacccacgtctcctcatgggaggaggtgccttacctgggcaagagggaagaccagtggtgcgggagcttgattggactgacagctcgagccacgtgggcaaccaatatacaggttgctatcaaccaagtgagacggctcattggtaatgagaactatcttgactacatgacttctatgaaaaggttcaagaatgaatccgatccagagggcgccctgtggtga

SEQ ID NO: 13195 - RNA, 9879 nt, synthetic construct
  misc_feature 1..9879: note = derived and/or modified CDS sequence (opt3) from DENV-1__JX669467__SS-prME
  source 1..9879: mol_type = other RNA
agcgtgaccatgctgctcatgcttctgccaacagcattggctttccacttaactacgagaggaggggagcctcatatgatcgtctccaagcaagaaaggggaaaatctctgctgtttaagacctcagccggtgttaacatgtgcacactcattgcaatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaaacagatccagaaggtggaaacttgggctctgaggcaccctggattcaccgttattgcactgtttctcgcccatgctatcggcacatcgattacccagaagggcatcattttcatcttactgatgcttgtgacgccatcaatggccatgcggtgcgtcgggattggaaaccgcgattttgtggagggtttgagcggcgcgacttgggtagacgttgtgctggagcacgggagttgtgtcacaaccatggccaagaataagcccactctagatatcgaactcctgaaaacagaggtgaccaaccctgccgtgcttagaaagctgtgcattgaagctaaaatctccaatacgaccacagactctaggtgtccaactcaaggagaggccaccttggtcgaagaacaagatgcaaacttcgtttgccggcgcacatttgtggaccgaggctggggtaatgggtgtggactcttcggcaagggcagcctgttaacttgcgctaagtttaaatgcgtaaccaagctggaggggaaaatagtgcagtacgaaaacctcaagtattccgtcattgtgacagttcacaccggagatcagcatcaagtgggtaatgagactacggaacacggcacaatcgccaccattactccccaggcgcctacctcagagatccagcttacagactacggggccctgaccttggactgtagtccaagaactggactagatttcaacgaaatggtcctgctcacaatgaaagaaaagagctggctggtgcataaacagtggtttcttgacctgccgttgccctggacgtctggcgcatccacctcacaagagacttggaataggcaggatctcctggtaacattcaagaccgctcacgccaagaaacaggaagttgtggtcttaggtagccaagagggggctatgcacacagccctgactggcgcaaccgaaatccagacgagtggaaccacaactatttttgccggccatctaaagtgccggctcaaaatggacaagctgacccttaaagggacatcttatgtgatgtgtactggatccttcaagttggagaaggaagtcgctgagacccagcacggtacggtgctggttcaggtgaaatacgagggcacagatgcgccttgcaagataccattcagcacccaagacgaaaaaggggtaactcagaacggacgtctcatcacagcaaatcccattgtcaccgataaggagaaacctgtgaacatcgaaactgagccaccctttggcgagtcgtatatagttgtgggtgccggggaaaaggctctgaaactttcttggttcaaaaagggctcctcaattggaaaaatgtttgaggccaccgcacgcggcgccagaaggatggctatcctgggggacacagcctgggatttcggaagtatcggtggcgtctttacgagcgtggggaagttggtacatcaggtgttcggaaccgcatacggcgttctcttttccggtgtctcttggactatgaaaattgggatcggcattctgttaacatggctgggactaaatagccggtcaaccagtctctccatgacatgtatagcggtgggcatggtgactctgtaccttggggtcatggttcaggctgacagcggatgcgtgatcaactggaagggccgagaattgaagtgtggttctgggattttcgtgaccaacgaggtacacacgtggacagaacaatataaatttcaggccgattcaccgaagcgcctgagtgcagccatcggacgagcttgggaggagggcgtctgcggtatcaggagcgccacccggctcgaaaatattatgtggaaacagatatccaacgagctgaatcatatcttactggaaaacgacattaagttcactgtggttgtgggcaatgcaaacgggatccttgctcagggcaaaaagatgattcgccctcaacccatggagcacaaatactcttggaagtcgtggggcaaggccaaaatcataggggcggacatccagaataccacatttattatcgatggaccagacactcctgaatgtcccgatgagcagagagcctggaacatttgggaggtcgaagactatggcttcggtatctttaccacaaatatatggttgaagctcagggatagctacacgcagatgtgcgaccaccgtctgatgtccgctgcaattaaagattcaaaggccgtgcatgctgacatggggtattggatcgagagtgagaaaaacgagacctggaagctagcccgggcatctttcattgaagttaagacttgtatctggccaaaaagccacacactgtggtccaatggagtgctcgagtcagagatgataatccccaagatgtacggcggtcctattagccaacataactatcgaccaggctacttcacccagactgcggggccgtggcacctgggaaaacttgaattggattttgacctgtgcgagggcacaaccgtagtcgtggatgaacactgcgggtctagaggaccctccttaaggacgactaccgtgacaggcaagatcattcatgagtggtgttgccgcagttgtaccctccctccactgcggttcagaggtgaggacgggtgctggtacggaatggaaatcaggcccgtcaaagagaaggaagagaatcttgttcgcagcatggtgtctgccggctccggtgaagtagattcatttagtctgggcatattgtgtgtgagcattatgatcgaggaggtcatgcgatcgcggtggtcccgtaagatgctcatgactgggacactggctgtgttcctactgctcatcatgggacagctgacctggaacgaccttattagattgtgcatcatggttggcgccaatgcatctgacaaaatggggatgggaacaacttatctggctttaatggccacctttaagatgaggcctatgttcgcagtgggcctcctgtttcgccggcttacgagcagagaagtcctgctactcacaattggtctgtcattggtggccagtgttgagctgccaaactccttagaggaactcggggatggactggctatgggcataatgatgcttaaactgttgaccgagttccaaccccaccagctctggactaccctgctatctctgacatttatcaagactacccttagcctcgactacgcgtggaaaacgacagccaccgtgctgtccattgtctcattgttcccgctgtgtttaagcactacaagtcagaagaccacttggctccctgtactgcttggctcttttgggtgcaagccactgacaatgttcttgatcaccgagaacgagatttggggaaggaaatcctggcccctcaatgaaggtatcatggcaataggcatcgtgagcattctgctatcgtcactgcttaagaacgatgttcctctcgctgggcccctgatcgccggaggcatgttgattgcctgttatgtgatctctggtagttccgctgacttaagcctggagaaagcagccgaagtctcttgggaggaagaggcggagcatagcgggacgtcccacaatatactcgtggaagtacaggatgacggaactatgaagattaaagatgaggaacgagacgataccctgacaatccttctgaaggctaccttgctagccgtgtcaggcgtctacccaatgagtatccctgcaacactgtttgtttggtatttctggcagaaaaagaagcagcgcagcggcgtgctctgggacactccctctccaccggaggtggagcgggccgtcctggatgacgggatttacagaatacttcagaggggattactgggtcgttcccaggtgggcgttggggtattccaagatggagtgtttcataccatgtggcacgtcacgcgcggcgctgtgctcatgtatcagggtaaacggttggaaccttcatgggcaagtgttaagaaagacctgatcagctacgggggaggctggagattccagggctcctggaacacaggggaggaagtgcaggtcattgccgtggagcccggaaagaatcccaaaaacgtacaaactacccccggtacatttaagacccctgaaggcgaggtcggggcgatcgctctcgacttcaagccaggaacttctggctcgcccattgtgaatagggagggtaaaatcgttgggctgtacggaaacggcgtggtcaccacaagcggcacgtatgtgtcagccatagcacaggccaaggcttcccaggaagggcctcttccggagatcgaagatgaggtttttaaaaagcgaaatctgactattatggacttgcacccaggaagtggtaaaacccggcgctacctacccgccatcgtgagagaagcaattaagaggaagctgcggacactcatcttagctcctacccgagtcgtggcctctgagatggcggaggccctgaaaggcatgccaataagatatcaaactacagcagtaaagagcgaacataccgggcgcgagattgtggatcttatgtgccacgctacgttcactatgaggctgctctcccccgttcgtgtccctaactacaatatgatcatcatggacgaagcccattttacagatccggcttcaattgcagcccggggatatatctctaccagagtgggcatgggtgaggccgctgcgatattcatgaccgcaactcccccagggagcgtggaagcctttcctcagagtaacgctgtcattcaggacgaggagagggatatccccgaacgctcctggaatagcggatacgactggattacagatttcccaggcaaaaccgtatggtttgtgccttctatcaagtcaggcaacgacatagccaattgtttgcggaaaaacgggaagagagttattcagctgtccagaaagacattcgatactgagtatcagaaaacgaagaacaatgactgggactacgtggtcaccacagatatcagtgaaatgggagcaaacttcagggccgaccgcgtgatcgatccccgtagatgcctcaaaccagttattctgaaggacggtccggagcgggtgatccttgctggccctatgcccgtcactgtggcgagcgccgcacagaggcgcgggcgaattggaagaaatcagaacaaagagggcgatcagtacgtatatatgggtcaaccactaaataacgacgaagatcacgctcattggaccgaggccaagatgctgttggacaatataaacacacccgaagggatcattcctgcattatttgagccagaacgggagaagtcggccgctatcgatggcgagtacaggctgcgcggagaagccagaaaaaccttcgtggagctcatgaggcggggcgacctgcccgtttggctttcttataaggtcgcgtccgaagggtttcagtacagcgatcgtcgctggtgcttcgacggagagcgaaataaccaggtgctggaagagaatatggatgtggagatctggactaaagaaggtgagagaaagaaactcaggcctcggtggttggacgcacgcacgtattcagacccgctggccctaagagaatttaaggagttcgctgccggcaggcggagtgtctctggggatctgattctcgaaataggaaaacttccacagcacctgaccttacgagctcaaaacgcattggacaatctggttatgctccacaactccgagcagggcggtaaggcctacagacatgctatggaggaactgcccgatacaatcgagactcttatgctgctcgccttgattgcagtgctgaccgggggcgtaacattatttttcctaagcggaaagggcctggggaaaacctcaatcggactcctttgtgtgactgcgagtagcgccctgttgtggatggcttccgtcgaacctcactggattgccgcatctatcatactggagtttttcctcatggtgctgcttatccccgagccagaccgccagaggacacctcaggataatcaactcgcttatgttgtgattggtctgttgtttatgatcctgacggtcgccgcaaacgaaatgggcttactagagaccactaagaaagacctggggattggacatgtagccgctgaaaaccaccagcacgcgacaatgctcgatgtggaccttcatcccgccagcgcatggaccctgtacgctgttgccaccacagtgatcactccaatgatgcggcacacgatagagaataccacagccaacatttccttgactgcaatcgctaatcaggccgcgattctgatgggcctcgataagggttggcctatctcaaaaatggacctgggggtcccgcttttagctctgggctgctactctcaagtgaaccccctcaccttgacagccgcagtcctgatgctagtggcccattatgctataatcggaccaggcctgcaggcaaaggccacccgtgaagcgcagaagagaactgctgccgggattatgaaaaatcctacggttgatggaatcgtggcaattgacctcgatcccgtagtgtacgacgccaagttcgagaaacagcttggccaaatcatgctgttgatactgtgtacaagtcagattctcctgatgaggaccacttgggctttatgcgagtcgatcacccttgccacaggtccactgactaccctctgggaagggagccctggaaagttttggaacacaacgatcgcagtctccatggctaatattttccgcggctcttatctagccggtgcgggcctggccttctcattgatgaaaagcctagggggaggccggcgagggaccggagcacagggcgagactctcggtgaaaagtggaagagacagcttaaccaactgtccaaaagtgagtttaatacatacaagaggtctgggatcatggaagttgaccgcagcgaggctaaagagggattgaagcggggcgaaaccactaaacacgccgtgtcaagaggtacagcaaagctgcgttggttcgtcgagaggaacctcgtgaagcccgaaggcaaagtaatagatttagggtgtggacggggcgggtggtcctattactgcgctggactgaagaaagtgaccgaggttaagggctatacgaaaggtgggccgggacatgaagaaccaattcctatggccacctacggctggaatcttgtgaagctgcacagtggcaaagacgtctttttcatgcccccagagaagtgtgatacactactctgcgacatcggggaaagctctcccaaccctactattgaggaaggacgcaccctgcgagtgttgaagatggtcgagccgtggctgagaggtaatcagttttgtatcaaaatactcaacccctacatgccatccgtggttgagacacttgaacagatgcagaggaagcacggcgggatgctggtacggaatcctttatcacgcaacagcactcatgagatgtattgggtgtcgtgcggaaccggcaatatcgtctctgccgtgaacatgacaagtagaatgctgttgaacaggttcaccatggcgcaccgaaaacccacttacgaacgggatgttgacctcggtgctgggacgcgtcatgtggcagtcgagcctgaagtggccaatctggatattatcggacaaagaattgagaacatcaagaatgagcacaaatccacatggcactatgacgaagataacccatacaagacctgggcttatcatggcagctacgaggtaaagccctcaggctccgcctctagcatggtgaatggggttgtccgcctacttactaaaccttgggacgtgattccaatggtgacccagatcgcaatgacagatacgaccccctttggacagcaaagggtcttcaaggaaaaagttgacactcggacaccgagagccaagcgcggtaccgctcagataatggaggtgactgcgaaatggctgtggggctttctcagtaggaacaagaagcctcgaatttgtacacgggaagagttcaccagaaaagtaaggtccaatgccgcaatcggggctgtgtttgtcgacgagaaccagtggaatagcgccaaggaagcagtggaggatgaacgcttctgggacctggttcaccgtgagcgggaattgcataaacagggaaagtgcgccacatgcgtgtataacatgatgggcaaaagagagaagaagctgggtgagtttgggaaagctaagggatctagggccatctggtacatgtggctcggcgcgcgcttccttgagttcgaggcactgggctttatgaatgaagatcactggttctcacgagagaacagtttatccggggtcgagggagaaggtctgcataaattgggctacattctccgggacataagcaagatcccagggggaaatatgtatgccgatgacactgctggctgggataccagaattacggaggacgatctgcaaaacgaagccaaaatcaccgacattatggagcccgaacacgcactacttgctacatctatctttaagctgacttaccagaataaagtggtaagggttcagcgccctgccaagaacggtaccgtgatggatgtcatatcgagacgggaccagagggggtcaggacaagtgggcacatatggcctcaacactttcaccaatatggaggtgcagctgatccgtcagatggagagcgaagggatatttttcccatccgagttggaaagtcccaacttagctgagcgagtcctggattggctcgaaaagcacggagccgagcgccttaaaagaatggcaatctctggtgacgactgtgttgtgaagccgattgatgaccggtttgcgacggccctgatcgctctaaatgatatgggcaaagtaaggaaggacatacctcagtgggagcccagcaaagggtggaacgattggcaacaggtgccattctgctcccatcactttcatcagctgattatgaaggacggacgcgaaatcgtcgtgccttgtagaaatcaggatgagctcgttggccgggccagggtgtcacaaggtgcagggtggagtttgcgagaaacagcttgcctgggaaagtcttacgcccagatgtggcagcttatgtatttccaccgtagagacctgcgcctcgcagccaacgcgatctgtagcgctgtccccgtggattgggtaccaacctcccggactacatggtcaattcacgcccatcaccaatggatgaccactgaggacatgttaagcgtttggaatagggtgtggatagaagagaacccctggatggaggataaaacccatgtctcttcctgggaagaggtgccttacctgggcaagagagaagaccagtggtgcggcagtttgatcgggctgacagcacgcgccacgtgggctaccaatattcaggttgccatcaaccaggtgcggaggctcattggaaatgagaactatcttgactacatgactagcatgaaacgatttaagaatgagtcggatccagaaggtgcactgtggtga

SEQ ID NO: 13196 - RNA, 9879 nt, synthetic construct
  misc_feature 1..9879: note = derived and/or modified CDS sequence (opt3) from DENV-1__HM469967__SS-prME
  source 1..9879: mol_type = other RNA
agcgtgaccatgctgctcatgcttatgcccacagcactggctttccacttgactacgaggggaggggaacctcatatgatcgtctccaagcaggaaaggggaaaatctttactgtttaagacctcagccggtgttaacatgtgcacactaattgccatggacctcggcgagctgtgtgaagatactatgacctacaaatgcccacggattacagaggcggaaccggacgatgtggactgttggtgcaatgctaccgatacttgggtaacatatgggacctgtagtcaaacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaactactcaagacagaggtgaccaaccctgccgtgctgaggaaactttgcattgaagctaagatctctaatacgaccacagatagccggtgtccaactcaaggagaggccaccctggtcgaagaacaagacgcaaacttcgtttgccgccgaacatttgtggatagaggctggggtaatgggtgtggattgttcggcaaaggctccctcataacttgcgctaagtttaagtgcgtaaccaaactggaggggaagattgtgcagtacgaaaacttaaaatattcagtcatcgtgacagttcacaccggagaccagcatcaagtgggtaatgagagtactgaacacggcacgacagccaccattactccccaggcgcctaccacagagatccagctgaccgactacggggccctcactcttgattgtagcccaaggacaggactggacttcaacgaaatggtcttgctaacgatgaaggagaaatcttggctggtgcataagcagtggtttctcgatctgccgcttccctggacctccggcgcatcaactagccaagagacatggaatcggcaggacctgttggtaaccttcaaaacagctcacgccaagaagcaggaagttgtggtcctcggtagtcaagagggggctatgcacactgccctgaccggcgcaacggaaatccagacctctggaacaactaccatttttgccggccatttaaaatgccgtctgaagatggataaactaacactcaaggggatgtcctatgtgatgtgtactggtagcttcaaactggagaaggaagtcgctgagacccagcacggaacggtgcttgttcagataaagtacgagggcacagacgcgccttgcaaaatcccattctcgacccaagatgaaaagggggtgactcagaacggacgcttgattacagcaaatcccatcgtaaccgacaaagagaagcctgtcaacatagaagccgagccaccctttggcgagtcttatattgtgatcggtgctggggaaaaagccctgaagctctcctggttcaagaaaggctcaagtatcggaaagatgtttgaggcaactgccagaggcgctaggcggatggccattctgggggataccgcatgggacttcggaagcatcggtggcgtttttacatccgtggggaaacttgtccatcagattttcggaacggcgtacggcgtgctgttttctggtgtaagctggaccatgaagatagggatcggcgtgttgctcacttggctgggattaaattcacgaagtacatccctgagcatgacctgtattgctgttggcctagtcacactctacctgggggtgatggtgcaggccgattctggatgcgtcatcaactggaaaggccgcgaacttaagtgtggttcagggatcttcgttactaatgaggtgcacacctggacggaacaatataagtttcaggcagacagtccgaaaagattgagcgccgctattggaaaggcctgggaggagggcgtgtgcggtataaggtccgcaacacggctggaaaacatcatgtggaaacagatttctaacgagctcaatcatatcctgttagaaaacgacatgaagttcaccgtagtcgtgggcgatgttgctgggattctggcccagggcaagaagatgatccgccctcaacccatggagtacaaatattcgtggaaaagctggggcaaggcgaagataatcggggccgacgtgcagaatactacctttattatcgatggaccaaacacacctgaatgtcccgacgatcagagagcttggaatatttgggaggtcgaggactacggcttcggtatctttactaccaacatatggcttaagttgagggattcctatacacaggtgtgcgaccaccgtctcatgtcagcagccattaaagatagtaaggctgttcacgccgacatggggtactggatcgaatctgagaaaaatgaaacgtggaagctggcacgggcgagcttcattgaggtgaagacctgtatctggccaaaatcccatactctatggtcaaacggagtactggaaagcgagatgataatccccaagatttatggcggtcctatctctcaacacaattaccgaccaggctacttcacacagaccgccgggccgtggcatctcggaaaactggagcttgattttgacttgtgcgaaggcactacagtcgtggtggatgagcactgcgggaacagaggaccctccctgaggaccacgactgtcaccggcaagattatccacgaatggtgttgccgcagttgtacattacctccactccggttcagaggtgaggacgggtgctggtatggaatggagataaggcccgttaaagaaaaggaggaaaatctggtgaagtccatggtatctgctggctccggtgaggtggactcatttagtcttggcctgttgtgtattagcatcatgatcgaagaggtcatgcgctcgcgatggtcccggaaaatgctcatgaccgggactctggccgtgttctttctactgattatgggacagctcacatggaacgatctgatccgtctttgcattatggttggcgcaaatgcttctgacagaatggggatgggaaccacatacttggccctgatggcaactttcaagatgaggcctatgtttgccgtgggcttactcttccgccggctgaccagcagagaggtccttctgctaacgataggtctctcactggtggctagtgttgaattgccaaactccctggaggaattaggggatggactcgcgatgggcatcatgattctgaaacttctgacagactttcaatctcatcagttgtgggccaccctcctgagcctaactttcatcaagaccacattttccctgcactatgcatggaaaactatggctatggtgctttcaattgtcagcctcttccccctgtgtttgagtaccacgtctcagaagacaacctggctgccggtattactcggctccctggggtgcaagcctcttactatgtttctgatcgccgagaataaaatatggggaagaaagagctggccattgaacgaaggtatcatggccgtgggcattgtttcgatcctcctgtcatctctactgaaaaacgatgtgccccttgctgggcctctcattgcaggaggcatgctgatcgcctgttacgtcataagtggttccagcgcggacttgtctttagagaaggctgccgaggtgagctgggaagaggaagcagagcattccggggcctcacacaatattctggtagaagtgcaggatgacggaacaatgaaaatcaaggatgaggagcgagacgataccctcactatcctgcttaaagctacactgttggcagtcagtggcgtttatcccctaagcattccagccaccctgttcgtgtggtacttctggcaaaagaagaaacagcgctctggcgtgctctgggacacgccttcacccccaaaggtcgaacgggcggtgctggatgacgggatatatagaatcatgcagaggggacttttaggtcgtagccaggttggcgtaggggtgtttcaagagaacgtcttccatactatgtggcacgtgacccgcggagctgttctgatgtaccagggcaaacggctcgaaccgagttgggccagcgtgaagaaagacttgatttcctacggtgggggatggagactgcagggctcttggaatacaggcgaggaggtccaggtgatcgcagtagaacctgggaagaaccccaagaatgtccaaaccgccccaggaacatttaaaactcccgagggtgaaattggcgctatcgccctcgatttcaagcctgggacctcgggaagcccaatagtgaacagggagggcaaaatcgttggtctgtatgggaatggagtggtcacgacatcaggcacttacgtgtccgcaattgctcaggccaaggcgagtcaggaaggcccccttcctgagatcgaggacgaagtttttcgaaaacggaacctgaccattatggatttgcacccggggtctggaaagacacgcagatatctaccagccatcgtgagggaggcaataaagcggaaactgcgaaccctcattttagctcccactagagtcgtggccagcgaaatggctgaggcactgaagggtatgcctatccgctaccaaaccacagccgtaaaatccgaacatacgggcaaggagatcgtggaccttatgtgccacgccactttcaccatgaggctgctctcaccagttcgtgtccccaattataacatgattatcatggatgaggctcattttacagacccttctagcatagcggcacgggggtacattagtaccagagtgggaatgggcgaagccgctgccatcttcatgactgcaacaccgcccggttccgtggaggcctttccacagagcaatgctgtcattcaggatgaagagagggacatccctgaacgctcttggaactcagggtatgagtggataaccgatttccccggaaaaacggtatggtttgtgccatccattaaggcgggcaatgacatcgccaactgtttgcgaaagaatggcaaaagagttatccagctgagtcggaagactttcgatacagagtaccagaaaaccaagaacagcgactgggactacgtggtcaccactgatatttcggaaatgggggcaaacttcagggctgaccgcgtgatcgatcctcgtagatgcctcaaacccgttattctgaaggacggaccagagcgggtgatacttgccggtccgatgcctgtcacagtggcatctgccgctcagaggcgcggccgagtagggagaaatcacaacaaggaaggagatcagtatatctacatgggccagcccctaaataacgacgaggatcatgcccactggaccgaggcgaaaatgctgttggacaatattaacacaccagaaggtatcatccccgcattatttgagcctgaacgggagaagtccgccgctattgatggggaatataggctgcgcggcgaggccagaaaaactttcgtggagctcatgaggcggggagacctgccagtttggcttagctacaaggtcgcttcagaaggctttcaatatagtgatcgtcgctggtgcttcgacggggagcgaaataaccaggtgctggaagagaatatggatgtggaaatatggacgaaagagggagagagaaagaaactcaggccccggtggttggacgcacgcacctactctgaccctctggccctaagagaatttaaggagttcgctgccggtaggcggtccgtcagcggcgatctgatcctcgaaattgggaaacttccgcagcacctgacacagcgagcacaaaacgcgttagacaatttggttatgctgcataactcagagcagggaggcagagcctatcgccacgctatggaagaactcccagatactatcgagaccctgatgcttctggccctcattgcagtgttgacaggtggggtaaccctgtttttcttaagtggcaggggactaggcaaaactagcatcgggctgctctgtgtgatggcttcctctgtccttctgtggatggccagcgtggaaccccattggatagcagcctccatcattttggagtttttcctgatggttctcctgatccctgaacccgaccggcagcgtacgccacaggataatcaacttgcttacgtggtcattggactcctgtttatgatcttgaccgtagcggccaacgagatgggtctgttagagacaactaagaaagacctaggcatagggcacgtggcagttgaaaatcaccatcacgctgccatgctggatgtggacctccatcctgcctcagcatggaccctttacgctgtcgccacaaccattatcactcccatgatgagacacacaattgagaacacgaccgcgaacatctctctgactgctatagccaatcaggcagccatcttgatgggactggataagggctggccaattagtaaaatggacatcggtgtgcctctcctggctcttgggtgctattcgcaggtcaacccgttaacactgaccgcagccgtgctcatgttggttgcgcattacgctattatcggccccggactgcaagccaaggcaaccagggaagcccagaagcgcacagctgccggcataatgaaaaatccaactgtggatgggattgtagcaatcgacctagatcctgtggtctatgacgctaagttcgagaaacagctgggacagatcatgctccttattctgtgtacgagccaaatcttgctgatgcggaccacatgggccctctgcgaatccataactctggcgaccggccccttaacaaccctttggaagggttctccagggaaattttggaacactacgattgccgtttcaatggcaaatatcttccgaggaagctacctggctggcgccggtctcgcattctccctaatgaagagtctgggcgggggaagaaggggcacaggggctcagggagagaccttgggcgagaagtggaaacgccagctgaaccagctctctaagagcgaatttaatacttataaacggtcaggtattatggaggtggacagatccgaagccaaggaggggcttaaacgtggagaaaccacaaagcacgccgtcagtaggggcactgcgaagctgaaatggttcgtggagcggaacttggtaaagcctgagggtaaagtgatcgatctgggctgtgggcgcggaggctggagctactattgcgctgggctcaagaaagttaccgaagtgaagggatacacaaaaggcggtcccgggcacgaggaaccgataccaatggcaacgtacggatggaatttagtcaagctgcattctggcaaggacgtgtttttcatccctcccgagaaatgtgatacccttctgtgcgacattggcgaatcctcaccaaaccccactatcgaggaggggcgaacactaagagtcctcaagatggtggaaccttggctgaggaaaaatcaattttgtattaagatcttgaacccgtatatgcccagcgttgtagagaccctggaacagatgcagcggaaacacggaggtatgctcgtgcgcaatccactttcgagaaactctactcatgagatgtactgggtcagttgcggcacagggaatattgtgtccgccgttaacatgaccagcaggatgctgttaaatcgattcacgatggctcaccggaagcctacctatgagcgtgatgtggacctgggagccggcacaagacacgtcgcagtggaacccgaggtagccaacttggatatcataggtcagcgcattgaaaacatcaagcatgagcacaaatcaacttggcattacgacgaagataatccttataagacctgggcttaccacgggtcctatgaggtgaaaccatctggaagcgcgagttccatggttaacggcgtcgtgaagctcctgacaaaaccctgggacgtgatccctatggtcactcaaattgccatgaccgatacaaccccatttggccagcagagggttttcaaggagaaggtggacactcggacgcccaaagcaaagagagggacagctcaaataatggaagtaaccgcccgctggctatggggatttcttagcaggaataaaaagccgcgaatctgtactcgggaggagttcaccagaaaagtgaggtctaacgcagccattggtgctgtctttgtggacgagaatcagtggaactcagccaaggaagcggttgaggatgagcgcttctgggacctggtgcatcgtgaacgggagctccacaagcagggcaaatgcgcaacatgcgtctacaatatgatggggaagagagagaaaaagctgggagagtttggcaaagccaagggtagtagggctatctggtacatgtggttgggggcccgcttcctggagttcgaggcactcggatttatgaacgaggatcactggttctcccgagaaaatagcctttctggcgtggagggcgaagggctgcataaattaggatatattctgcgggacatctcgaagatacctggtggcaacatgtacgctgatgacacggccgggtgggataccagaatcactgaggacgatttgcagaatgaggctaagattacagacatcatggaaccagagcacgccctcctggcaaaatcaatttttaagctaacctatcaaaacaaagtagttagggtgcagcgccccgcgaagaatggaactgtcatggatgtgatcagcagacgggaccagaggggctccggtcaggtggggacatacggacttaacaccttcacaaatatggaagcccaactgatacgtcagatggagagtgaaggcatattttctcctagcgagctcgagactccaaacctggctgaacgagtcttggattggttagagaaatatggcgttgaacgcctgaagagaatggccatctccggggacgactgtgtggtaaagcccatcgatgaccggttcgcaaccgctctcacggcccttaacgatatgggaaaagtgaggaaggacattccgcagtgggagccttcaaaaggttggaatgattggcagaaggtccccttttgcagtcatcacttccaccaactgataatgaaagacggccgcgaaatcgtggttccatgtagaaaccaggatgagctagtggggcgggcaagggtctctcagggagccggctggagcctgcgagagaccgcgtgcctcggtaagtcctacgctcagatgtggcaattgatgtattttcatcgtagagacctgcgccttgccgcaaatgccatttgttcagctgtgcctgtagattgggttcccacaagccggactacctggtctatccacgcccatcaccagtggatgacaactgaagacatgctgtccgtgtggaacagggtctggattgaggaaaatccatggatggaggataagacccatatcagtagctgggaagacgtgccctacctcgggaaaagagaggaccagtggtgcggatcgttaataggcctgacggcacgcgctacatgggccaccaacatccaagttgcgattaatcaggtgcggaggttgatcggcaacgagaattacctggattatatgacttccatgaagcgattcaaaaacgaatctgaccctgagggggctctctggtga

SEQ ID NO: 13197 - RNA, 9879 nt, synthetic construct
  misc_feature 1..9879: note = derived and/or modified CDS sequence (opt3) from DENV-1__JX669468__SS-prME
  source 1..9879: mol_type = other RNA
agcgtgaccatgctgctcatgcttctgccaactgcattggctttccacttaactacgagaggaggggagcctcatatgatcgtctccaagcaagaaaggggaaaatctctgctgtttaagacctcagccggtgttaacatgtgcacactcattgcaatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaaacagatccagaaggtggaaacttgggctctgaggcaccctggattcaccgttattgcactgtttctcgcccatgctatcggcacatcgattacccagaagggcatcattttcatcttactgatgcttgtgacgccatcaatggccatgcggtgcgtcgggattggaaaccgcgattttgtggagggtttgagcggcgcgacttgggtagacgttgtgctggagcacgggagttgtgtcacaaccatggccaagaataagcccactctagatatcgaactcctgaaaacagaggtgaccaaccctgccgtgcttagaaagctgtgcattgaagctaaaatctccaatacgaccacagactctaggtgtccaactcaaggagaggccaccttggtcgaggaacaagatgcaaacttcgtttgccggcgcacatttgtggaccgaggctggggtaatgggtgtggactcttcggcaagggcagcctgttaacttgcgctaagtttaaatgcgtaaccaagctggaggggaaaatagtgcagtacgaaaacctcaagtattccgtcattgtgacagttcacaccggagatcagcatcaagtgggtaatgagactacggaacacggcacaatcgccaccattactccccaggcgcctacctcagagatccagcttacagactacggggccctgaccttggactgtagtccaagaactggactagatttcaacgaaatggtcctgctcacaatgaaagaaaagagctggctggtgcataaacagtggtttcttgacctgccgttgccctggacgtctggcgcatccacctcacaagagacttggaataggcaggatctcctggtaacattcaagaccgctcacgccaagaaacaggaagttgtggtcttaggtagccaagagggggctatgcacacagccctgactggcgcaaccgaaatccagacgagtggaaccacaactatttttgccggccatctaaagtgccggctcaaaatggacaagctgacccttaaagggacatcttatgtgatgtgtactggatccttcaagttggagaaggaagtcgctgagacccagcacggtacggtgctggttcaggtgaaatacgagggcacagatgcgccttgcaagataccattcagcacccaagacgaaaaaggggtaactcagaacggacgtctcatcacagcaaatcccattgtcaccgataaggagaaacctgtgaacatcgaaactgagccaccctttggcgagtcgtatatagttgtgggtgccggggaaaaggctctgaaactttcttggttcaaaaagggctcctcaattggaaaaatgtttgaggccaccgcacgcggcgccagaaggatggctatcctgggggacacagcctgggatttcggaagtatcggtggcgtctttacgagcgtggggaagttggtacatcaggtgttcggaaccgcatacggcgttctcttttccggtgtctcttggactatgaaaattgggatcggcattctgttaacatggctgggactaaatagccggtcaaccagtctctccatgacatgtatagcggtgggcatggtgactctgtaccttggggtcatggttcaggctgacagcggatgcgtgatcaactggaagggccgagaattgaagtgtggtaacgggattttcgtgaccaatgaggtacacacgtggacagaacaatataaatttcaggccgattctccgaagcgcctgtcagcagccatcggacgagcttgggaggagggcgtctgcggtatcaggagtgccacccggctcgaaaacattatgtggaaacagataagcaatgagctgaaccatatcttactggaaaatgacattaagttcactgtggttgtgggcaacgcaaatgggatccttgctcagggcaaaaagatgattcgccctcaacccatggagcacaaatactcctggaagtcttggggcaaggccaaaatcataggggcggacatccagaacaccacatttattatcgatggaccagacactcctgaatgtcccgatgagcagagagcctggaatatttgggaggtcgaagactatggcttcggtatctttaccacaaacatatggttgaagctcagggattcgtacacgcagatgtgcgaccaccgtctgatgagcgctgcaattaaagattccaaggccgtgcatgctgacatggggtattggatcgagtcagagaaaaatgagacctggaagctagcccgggcaagtttcattgaagttaagacttgtatctggccaaaatctcacacactgtggagcaacggagtgctcgagtccgagatgataatccccaagatgtacggcggtcctatttcacaacataattatcgaccaggctacttcacccagactgcggggccgtggcacctgggaaaacttgaattggattttgacctgtgcgagggcacaaccgtagtcgtggatgaacactgcgggagcagaggaccctctttaaggacgactaccgtgacaggcaagatcattcatgagtggtgttgccgctcctgtaccctccctccactgcggttcagaggtgaggacgggtgctggtacggaatggaaatcaggcccgtcaaagagaaggaagagaaccttgttcgcagtatggtgagcgccggctctggtgaagtagattccttttcactgggcatattgtgtgtgagtattatgatcgaggaggtcatgcgaagccggtggtcgcgtaagatgctcatgactgggacactggctgtgttcctactgctcatcatgggacagctgacctggaatgaccttattagattgtgcatcatggttggcgccaacgcatccgacaaaatggggatgggaacaacttatctggctttaatggccacctttaagatgaggcctatgttcgcagtgggcctcctgtttcgccggcttacgtctagagaagtcctgctactcacaattggtctgagcttggtggcctcagttgagctgccaaacagtttagaggaactcggggatggactggctatgggcataatgatgcttaaactgttgaccgagttccaaccccaccagctctggactaccctgctatccctgacatttatcaagactaccctttctctcgactacgcgtggaaaacgacagccaccgtgctgagcattgtctccttgttcccgctgtgtttatcaactacaagccagaagaccacttggctccctgtactgcttggcagttttgggtgcaagccactgacaatgttcttgatcaccgagaatgagatttggggaaggaaatcttggcccctcaacgaaggtatcatggcaataggcatcgtgtccattctgctaagctcgctgcttaagaatgatgttcctctcgctgggcccctgatcgccggaggcatgttgattgcctgttatgtgatctcaggttctagtgctgacttatccctggagaaagcagccgaagtcagctgggaggaagaggcggagcattctgggacgagccacaacatactcgtggaagtacaggatgacggaactatgaagattaaagatgaggaacgagacgataccctgacaatccttctgaaggctaccttgctagccgtgtccggcgtctacccaatgtcaatccctgcaacactgtttgtttggtatttctggcagaaaaagaagcagcgcagtggcgtgctctgggacactcccagcccaccggaggtggagcgggccgtcctggatgacgggatttacagaatacttcagaggggattactgggtcgttctcaggtgggcgttggggtattccaagatggagtgtttcataccatgtggcacgtcacgcgcggcgctgtgctcatgtatcagggtaaacggttggaaccttcctgggcatcagttaagaaagacctgatcagttacgggggaggctggagattccagggcagctggaatacaggggaggaagtgcaggtcattgccgtggagcccggaaagaaccccaaaaatgtacaaactacccccggtacatttaagacccctgaaggcgaggtcggggcgatcgctctcgacttcaagccaggaacttccggctctcccattgtgaacagggagggtaaaatcgttgggctgtacggaaatggcgtggtcaccacatcgggcacgtatgtgagcgccatagcacaggccaaggcttcacaggaagggcctcttccggagatcgaagatgaggtttttaaaaagcgaaacctgactattatggacttgcacccaggatccggtaaaacccggcgctacctacccgccatcgtgagagaagcaattaagaggaagctgcggacactcatcttagctcctacccgagtcgtggccagtgagatggcggaggccctgaaaggcatgccaataagatatcaaactacagcagtaaagtctgaacataccgggcgcgagattgtggatcttatgtgccacgctacgttcactatgaggctgctcagccccgttcgtgtccctaattacaacatgatcatcatggacgaagcccattttacagatccggcttccattgcagcccggggatatatctcaaccagagtgggcatgggtgaggccgctgcgatattcatgaccgcaactcccccagggtctgtggaagcctttcctcagagcaatgctgtcattcaggacgaggagagggatatccccgaacgcagttggaactccggatacgactggattacagatttcccaggcaaaaccgtatggtttgtgcctagcatcaagtctggcaatgacatagccaactgtttgcggaaaaacgggaagagagttattcagctgtcaagaaagacattcgatactgagtatcagaaaacgaagaataacgactgggactacgtggtcaccacagatatctccgaaatgggagcaaatttcagggccgaccgcgtgatcgatccccgtagatgcctcaaaccagttattctgaaggacggtccggagcgggtgatccttgctggccctatgcccgtcactgtggcgagtgccgcacagaggcgcgggcgaattggaagaaaccagaataaagagggcgatcagtacgtatatatgggtcaaccactaaacaatgacgaagatcacgctcattggaccgaggccaagatgctgttggacaacataaatacacccgaagggatcattcctgcattatttgagccagaacgggaaaagagcgccgctatcgatggcgagtacaggctgcgcggagaagccagaaaaaccttcgtggagctcatgaggcggggcgacctgcccgtttggctttcgtataaggtcgcgtctgaagggtttcagtactccgatcgtcgctggtgcttcgacggagagcgaaacaatcaggtgctggaagagaacatggatgtggagatctggactaaagaaggtgagagaaagaaactcaggcctcggtggttggacgcacgcacgtatagcgacccgctggccctaagagaatttaaggagttcgctgccggcaggcggtcagtcagtggggatctgattctcgaaataggaaaacttccacagcacctgaccttacgagctcaaaatgcattggacaacctggttatgctccacaattctgagcagggcggtaaggcctacagacatgctatggaggaactgcccgatacaatcgagactcttatgctgctcgccttgattgcagtgctgaccgggggcgtaacattatttttcctatccggaaagggcctggggaaaaccagcatcggactcctttgtgtgactgcgtcaagtgccctgttgtggatggctagcgtcgaacctcactggattgccgcatccatcatactggagtttttcctcatggtgctgcttatccccgagccagaccgccagaggacacctcaggataaccaactcgcttatgttgtgattggtctgttgtttatgatcctgacggtcgccgcaaacgaaatgggcttactagagaccactaagaaagacctggggattggacatgtagccgctgaaaatcaccagcacgcgacaatgctcgatgtggaccttcatcccgcctctgcatggaccctgtacgctgttgccaccacagtgatcactccaatgatgcggcacacgatagagaacaccacagccaatattagcttgactgcaatcgctaaccaggccgcgattctgatgggcctcgataagggttggcctatctccaaaatggacctgggggtcccgcttttagctctgggctgctactcacaagtgaatcccctcaccttgacagccgcagtcctgatgctagtggcccattatgctataatcggaccaggcctgcaggcaaaggccacccgtgaagcgcagaagagaactgctgccgggattatgaaaaaccctacggttgatggaatcgtggcaattgacctcgatcccgtagtgtacgacgccaagttcgagaaacagcttggccaaatcatgctgttgatactgtgtacatctcagattctcctgatgaggaccacttgggctttatgcgagagtatcacccttgccacaggtccactgactaccctctgggaagggtcgcctggaaagttttggaatacaacgatcgcagtcagcatggctaacattttccgcggctcctatctagccggtgcgggcctggccttctctttgatgaaatcactagggggaggccggcgagggaccggagcacagggcgagactctcggtgaaaagtggaagagacagcttaatcaactgagcaaatccgagtttaacacatacaagaggagtgggatcatggaagttgaccgctctgaggctaaagagggattgaagcggggcgaaaccactaaacacgccgtgagcagaggtacagcaaagctgcgttggttcgtcgagaggaatctcgtgaagcccgaaggcaaagtaatagatttagggtgtggacggggcgggtggtcatattactgcgctggactgaagaaagtgaccgaggttaagggctatacgaaaggtgggccgggacatgaggaaccaattcctatggccacctacggctggaaccttgtgaagctgcactccggcaaagacgtctttttcatgcccccagagaagtgtgatacactactctgcgacatcggggaaagtagccccaatcctactattgaggaaggacgcaccctgcgagtgttgaagatggtcgagccgtggctgagaggtaaccagttttgtatcaaaatactcaatccctacatgccatctgtggttgagacacttgaacagatgcagaggaagcacggcgggatgctggtacggaaccctttatcccgcaattcaactcatgagatgtattgggtgagctgcggaaccggcaacatcgtctcggccgtgaacatgacatctagaatgctgttgaataggttcaccatggcgcaccgaaaacccacttacgaacgggatgttgacctcggtgctgggacgcgtcatgtggcagtcgagcctgaagtggccaacctggatattatcggacaaagaattgagaatatcaagaacgagcacaaaagtacatggcactatgacgaagataatccatacaagacctgggcttatcatggctcctacgaggtaaagcccagcggctcagcctcctctatggtgaacggggttgtccgcctacttactaaaccttgggacgtgattccaatggtgacccagatcgcaatgacagatacgaccccctttggacagcaaagggtcttcaaggaaaaagttgacactcggacaccgagagccaagcgcggtaccgctcagataatggaggtgactgcgaaatggctgtggggctttctcagcaggaataagaagcctcgaatttgtacacgggaagagttcaccagaaaagtaaggagtaacgccgcaatcggggctgtgtttgtcgacgagaatcagtggaactccgccaaggaagcagtggaggatgaacgcttctgggacctggttcaccgtgagcgggaattgcataaacagggaaagtgcgccacatgcgtgtataatatgatgggcaaaagagagaagaagctgggtgagtttgggaaagctaagggaagcagggccatctggtacatgtggctcggcgcgcgcttccttgagttcgaggcactgggctttatgaacgaagatcactggttctctcgagaaaattcattaagtggggtcgagggagaaggtctgcataaattgggctacattctccgggacatatccaagatcccagggggaaacatgtatgccgatgacactgctggctgggataccagaattacggaggacgatctgcaaaatgaagccaaaatcaccgacattatggagcccgaacacgcactacttgctacaagcatctttaagctgacttaccagaacaaagtggtaagggttcagcgccctgccaagaacggtaccgtgatggatgtcatatctagacgggaccagagggggtcgggacaagtgggcacatatggcctcaatactttcaccaacatggaggtgcagctgatccgtcagatggagtcagaagggatatttttcccaagcgagttggaatcccccaatttagctgagcgagtcctggattggctcgaaaagcacggagccgagcgccttaaaagaatggcaatcagtggtgacgactgtgttgtgaagccgattgatgaccggtttgcgacggccctgatcgctctaaacgatatgggcaaagtaaggaaggacatacctcagtgggagccctctaaagggtggaatgattggcaacaggtgccattctgcagccatcactttcatcagctgattatgaaggacggacgcgaaatcgtcgtgccttgtagaaaccaggatgagctcgttggccgggccagggtgtcccaaggtgcagggtggtcattgcgagaaacagcttgcctgggaaagagttacgcccagatgtggcagcttatgtatttccaccgtagagacctgcgcctcgcagccaatgcgatctgttctgctgtccccgtggattgggtaccaaccagccggactacatggtccattcacgcccatcaccaatggatgaccactgaggacatgttatcagtttggaacagggtgtggatagaagagaatccctggatggaggataaaacccatgtcagctcttgggaagaggtgccttacctgggcaagagagaagaccagtggtgcggctccttgatcgggctgacagcacgcgccacgtgggctaccaacattcaggttgccatcaatcaggtgcggaggctcattggaaacgagaattatcttgactacatgacaagtatgaaacgatttaagaacgagagcgatccagaaggtgcactgtggtga

SEQ ID NO: 13198 - RNA, 9879 nt, synthetic construct
  misc_feature 1..9879: note = derived and/or modified CDS sequence (opt3) from DENV-1__JX669469__SS-prME
  source 1..9879: mol_type = other RNA
agcgtgaccatgctgctcatgcttctgcccactgcattggctttccacttaactacgagaggaggggaacctcatatgatcgtctccaagcaggaaagaggaaaatctctgctatttaagacctcagccggtgttaacatgtgcacactcattgcaatggacctgggcgaactttgtgaagatactatgacctacaaatgcccacggataaccgaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaaacagatccagaaggtggaaacttgggctctgaggcaccctggattcaccgttattgcactgtttctcgcccatgctatcggcacatcgattacccagaagggcatcatattcatcttactgatgcttgtgacgccatcaatggccatgcggtgcgtcgggattggaaaccgcgattttgtggagggtttgagcggcgcgacttgggtagacgttgtgctggagcacgggagttgtgtcacaaccatggccaagaataagcccactctagatatcgaactcctgaaaacagaggtgaccaaccctgccgtgcttagaaagctgtgcattaaagctaagatctccaatacgaccacagactctaggtgtccaactcaaggagaagccaccttggtcgaggaacaggatgcaaacttcgtttgccggcgcacatttgtggaccgaggctggggtaatgggtgtggactcttcggcaagggcagcctgttaacttgcgctaaatttaagtgcgtaaccaaactggaggggaagatagtgcagtacgagaacctcaaatattccgtcattgtgacagttcacaccggagatcagcatcaagtgggtaatgaaactacggagcacggcacaatcgccaccattactccccaggcgcctacctcagaaatccagcttacagactacggggccctgaccttggactgtagtccaagaactggactagatttcaacgagatggtcctgctcacaatgaaggaaaagagctggctggtgcataagcagtggtttcttgacctgccgttgccctggacgtctggcgcatccacctcacaagagacttggaataggcaggatctcctggtaacattcaagaccgctcacgccaaaaagcaggaggttgtggtcttaggtagccaagagggggctatgcacacagccctgactggcgcaaccgagatccagacgagtggaaccacaactatttttgccggccatctaaaatgccggctcaagatggacaaactgacccttaaggggacatcttatgtgatgtgtactggatccttcaagttggaaaaagaggtcgctgaaacccagcacggtacggtgctggttcaggtgaagtacgagggcacagatgcgccttgcaaaataccattcagcacccaagacgagaagggggtaactcagaacggacgtctcatcacagcaaatcccattgtcaccgataaagaaaagcctgtgaacatcgagactgaaccaccctttggcgagtcgtatatagttgtgggtgccggggagaaggctctgaaactttcttggttcaagaaaggctcctcaattggaaagatgtttgaagccaccgcacgcggcgccagaaggatggctatcctgggggacacagcctgggatttcggaagtatcggtggcgtctttacgagcgtggggaaattggtacatcaggtgttcggaaccgcatacggcgttctcttttccggtgtctcttggactatgaagattgggatcggcattctgttaacatggctgggactaaatagccggtcaaccagtctctccatgacatgtatagcggtgggcatggtgactctgtaccttggggtcatggttcaggctgacagcggatgcgtgatcaactggaagggccgagagttgaaatgtggttctgggattttcgtgaccaacgaagtacacacgtggacagagcaatataagtttcaggccgattcaccgaaacgcctgagtgcagccatcggcagagcttgggaagagggcgtctgcggtatcaggagcgccacccggctcgagaatattatgtggaagcagatatccaacgaactgaatcatatcttactggagaacgacattaaattcactgtggttgtgggcaatgcaaacgggatccttgctcagggaaagaaaatgattcgccctcaacccatggaacacaagtactcttggaagtcgtggggcaaagccaagatcataggggcggacatccagaataccacatttattatcgatggaccagacactcctgagtgtcccgatgaacagagagcctggaacatttgggaggtcgaggactatggcttcggtatctttaccacaaatatatggttgaaactcagggatagctacacgcagatgtgcgaccaccgtctgatgtccgctgcaattaaggattcaaaagccgtgcatgctgacatggggtattggatcgaaagtgagaagaacgaaacctggaagctagcccgggcatctttcattgaggttaaaacttgtatctggccaaagagccacacactgtggtccaatggagtgctcgaatcagagatgataatccccaaaatgtacggcggtcctattagccaacataactatcgaccaggctacttcacccagactgcggggccgtggcacctgggaaaacttgagttggattttgacctgtgcgaaggcacaaccgtagtcgtggatgagcactgcgggtctagaggaccctccttaaggacgactaccgtgacaggcaaaatcattcatgaatggtgttgccgcagttgtaccctccctccactgcggttcagaggtgaggacgggtgctggtacggaatggagatcaggcccgtcaaggaaaaggaggaaaatcttgttcgcagcatggtgtctgccggctccggtgaggtagattcatttagtctgggcatattgtgtgtgagcattatgatcgaagaggtcatgcgatcgcggtggtcccgtaaaatgctcatgactgggacactggctgtgttcctactgctcatcatggcccagctgacctggaacgaccttattagattgtgcatcatggttggagcaaatgcttctgacaagatgggcatggggacaacttatctggccttaatggcaacctttaaaatgaggcctatgttcgccgtgggactcctgtttcgccggcttacgagcagagaggtcctgctactcacaattggcctgtcattggtggctagtgttgaactgccaaactccttagaggaactcggtgatgggctggcgatgggaataatgatgcttaagctgttgaccgagttccaaccccaccagctctggactaccctgctatctctgacatttatcaaaactacccttagcctcgactacgcctggaagacgacagcaatggtgctgtccattgtctcattgttcccgctgtgtttaagcaccacaagtcagaagacaacctggctccctgtactgcttggctcttttggctgcaaaccactgactatgttcttgatcacagaaaacgagatttgggggaggaagtcctggcccctcaatgagggaatcatggctataggtatcgtgagcattctgctatcgtcactgcttaaaaacgatgttcctctcgccggccccctgatcgccgggggaatgttgattgcttgttatgtgatctctggcagttccgcagacttaagcctggaaaaggccgcggaggtctcttgggaagaggaagctgagcatagcggtacctcccacaatatactcgtggaggtacaggatgacgggacgatgaaaattaaggatgaagaacgagacgatactctgaccatccttctgaaagccacattgctagcagtgtcaggagtctacccaatgagtatccctgccaccctgtttgtttggtatttctggcaaaagaagaaacagcgcagcggcgtgctctgggacacaccctctccaccggaagtggagcgggctgtcctggatgacggcatttacagaatacttcagagggggttactgggacgttcccaggtgggtgttggcgtattccaagatggggtgtttcatactatgtggcacgtcacccgcggagcagtgctcatgtatcagggcaagcggttggagccttcatgggccagtgttaaaaaggacctgatcagctacggtgggggatggagattccagggctcctggaacacgggcgaagaggtgcaggtcattgcggtggaacccgggaaaaatccaaagaacgtacaaacaactcccggaacctttaagacacctgagggtgaagtcggcgctatcgccctcgacttcaaaccagggacctctggatcgcccattgtgaatagggagggcaagatcgttggtctgtacgggaacggagtggtcactaccagcggcacatatgtgtcagcaatagcccaggctaaagcctcccaggagggccctcttccggaaatcgaggatgaagtttttaagaaacgaaatctgacgattatggacttgcacccagggagtggaaagactcggcgctacctacccgcaatcgtgagagaggctattaagaggaaactgcggaccctcatcttagcccctacacgagtcgtggcgtctgaaatggccgaggcactgaagggtatgccaataagatatcaaaccactgctgtaaaaagcgagcatacaggccgcgaaattgtggatcttatgtgccacgccaccttcacgatgaggctgctctcccccgttcgtgtccctaactacaatatgatcatcatggacgaggctcattttactgatccggcatcaattgccgcccgggggtatatctctacaagagtgggaatgggcgaagctgcggcaatattcatgaccgccacacccccaggtagcgtggaggcttttcctcagagtaacgccgtcattcaggacgaagagagggatatccccgagcgctcctggaatagcgggtacgactggattactgatttcccaggaaagacagtatggtttgtgccttctatcaaatcaggcaacgacatagcaaattgtttgcgaaagaacggcaagagagttattcagctgtcccggaaaaccttcgatacagaatatcaaaagactaaaaacaatgactgggactacgtggtcacgaccgatatcagtgagatgggggccaacttcagggctgaccgcgtgatcgatccccgtagatgcctcaagccagttattctgaaagacggaccggaacgggtgatccttgcgggtcctatgcccgtcacagtggccagcgcagctcagaggcgcggccgaattgggagaaatcagaacaaggagggagatcagtacgtatatatgggccaaccactaaataacgacgaggatcacgcccattggactgaagcaaagatgctgttggacaatataaacacccccgagggtatcattcctgccttatttgaaccagagcgggaaaaatcggctgccatcgatggggagtacaggctgcgcggcgaggcgagaaagacattcgtggaactcatgaggcggggagacctgcccgtttggctttcttataaagtcgcatccgagggctttcagtacagcgatcgtcgctggtgcttcgacggggaacgaaataaccaggtgctggaggaaaatatggatgtggagatctggaccaaggagggagaaaggaagaagctcaggcctcggtggttggacgcccgcacttattcagacccgctggctctaagagagtttaaagagttcgccgctggtaggcggagtgtctctggcgatctgattctcgagatagggaaacttccacagcacctgacgttacgagcacaaaacgccttggacaatctggttatgctccacaactccgaacagggaggcaaggcttacagacatgccatggaggagctgcccgataccatcgaaacacttatgctgctcgcattgattgcggtgctgactggtggggtaaccttatttttcctaagcggcaaaggactgggcaagacatcaatcgggctcctttgtgtgaccgccagtagcgctctgttgtggatggcctccgtcgagcctcactggattgcagcttctatcatactggaatttttcctcatggtgctgcttatccccgagccagaccgccagaggactcctcaggataatcaactcgcctatgttgtgattggactgttgtttatgatcctgacagtcgcagccaacgagatgggtttactagaaacgaccaaaaaggacctgggcattgggcatgtagctgcggagaaccaccagcacgccactatcctcgatgtggaccttcatcccgcaagcgcttggacactgtacgccgttgccaccaccgtgataacaccaatgatgcggcacactattgaaaatacgaccgcaaacatctccttgacagctattgccaatcaggcggctatcctgatgggactcgataaaggctggcctatatcaaagatggacctgggtgtcccgcttttagccctggggtgctactctcaagtgaaccccctcactttgaccgcagccgtcctgatgctagtggctcattatgcaatcattggcccaggactgcaggccaaggcgacacgtgaggctcagaaaagaaccgccgcaggcatcatgaagaatcctactgttgatgggattgtggccatcgacctcgatcccgtagtgtacgacgctaaattcgaaaagcagcttggacaaataatgctgttgattctgtgtacgagtcagatcctcctgatgaggacaacctgggccttatgcgagtcgatcactcttgcaaccggcccactgacaactctctgggagggtagccctgggaaattttggaacaccacaattgctgtctccatggccaatatcttccgcggatcttatctagcgggcgccggtctggcattctcattgatgaaaagcctgggcgggggacggcgaggcacgggggctcagggagaaaccctcggcgagaagtggaaaagacagcttaaccaactgtccaagagtgaatttaatacttacaaaaggtctggtataatggaggttgaccgcagcgaagccaaggaggggttgaaacggggagagacaaccaagcacgcagtgtcaagaggcactgctaagctgcgttggttcgtcgaaaggaacctcgtgaaacccgagggtaaggtaattgatttaggctgtgggcggggaggctggtcctattactgcgccgggctgaaaaaggtgacagaagttaaaggatataccaagggcggtccggggcatgaggaaccaatccctatggccacgtacggatggaatcttgtgaaactgcacagtggcaaggacgtctttttcatgcccccagagaagtgtgataccctactctgcgacattggcgagagctctcccaaccctacaatcgaagaggggcgcactctgcgagtgttgaaaatggtcgaaccgtggctgagaggaaatcagttttgtataaagatcctcaacccctacatgccatccgtggttgagacccttgagcagatgcagaggaaacacggtggcatgctggtacggaatcctttatcacgcaacagcacacatgaaatgtattgggtgtcgtgcgggactggaaatattgtctctgcggtgaacatgaccagtagaatgctgttgaacaggttcacaatggctcaccgaaagcccacctacgagcgggatgttgacctcggcgcaggtactcgtcatgtggccgtcgaacctgaggtggctaatctggatatcattgggcaaagaatcgaaaacattaaaaatgagcacaagtccacgtggcactatgacgaggataacccatacaagacatgggcctatcatggaagctacgaagtaaaaccctcaggctccgcatctagcatggtgaatggcgttgtccgcctacttaccaagccttgggacgtgatcccaatggtgactcagatagccatgaccgatacaacgccctttgggcagcaaagggtcttcaaagagaaggttgacacccggactccgagagctaaacgcggaacagcgcagattatggaagtgaccgccaagtggctgtggggttttctcagtaggaacaagaaacctcgaatctgtactcgggaggagttcacaagaaaggtaaggtccaatgcagctatcggcgccgtgtttgtcgacgagaaccagtggaatagcgcaaaagaggccgtggaagatgagcgcttctgggacctggttcaccgtgaacgggagttgcataagcaggggaaatgcgctacctgcgtgtataacatgatgggaaagagagaaaagaaactgggcgagtttggtaaggccaaagggtctagggcgatttggtacatgtggctcggagcacgcttccttgagttcgaagccctgggctttatgaatgaggatcactggttctcacgagaaaacagtttatccggcgtcgagggggagggactgcataagttgggttacatactccgggacatcagcaaaattccaggcgggaatatgtatgctgatgacacagccggatgggatactagaatcaccgaagacgatctgcaaaacgaggcaaagattacggacatcatggaacccgagcacgctctacttgccacctctatatttaaactgacataccagaataaggtggtaagggttcagcgccctgctaagaacggcactgtgatggatgtcatctcgagacgggaccagaggggttcagggcaagtgggaacctatggcctcaacacattcactaatatggaagtgcagctgattcgtcagatggagagcgagggcatctttttcccatccgaattggagagtcccaacttagccgaacgagtcctggattggctcgagaaacacggggcagaacgccttaagagaatggcgatttctggagacgactgtgttgtgaaaccgatcgatgaccggtttgccaccgctctgatagccctaaatgatatgggtaaggtaaggaaagacattcctcagtgggagcccagcaagggctggaacgattggcaacaggtgccattctgctcccatcactttcatcagctgatcatgaaggacgggcgcgagatcgtcgtgccttgtagaaatcaggatgaactcgttggacgggcaagggtgtcacaaggcgctggttggagtttgcgagagacggcctgcctggggaaatcttacgcacagatgtggcagcttatgtatttccaccgtagagacctgcgcctcgccgcgaacgctatttgtagcgccgtccccgtggattgggtaccaacatcccggaccacttggtcaatacacgcacatcaccaatggatgacaaccgaagacatgttaagcgtttggaatagggtgtggatcgaggaaaacccctggatggaggataagactcatgtctcttcctgggaggaagtgccttacctgggaaaaagagaggaccagtggtgcggcagtttgattggcctgaccgcccgcgctacatgggccacgaatatccaggttgcaattaaccaggtgcggaggctcatcgggaatgaaaactatcttgactacatgaccagcatgaagcgatttaaaaatgagtcggatccagagggagctctgtggtga

SEQ ID NO: 13199 - RNA, 9879 nt, synthetic construct
  misc_feature 1..9879: note = derived and/or modified CDS sequence (opt3) from DENV-1__JX669470__SS-prME
  source 1..9879: mol_type = other RNA
agcgtgaccatgctgctcatgcttctgccaacagcattggctttccacttaactacgagaggaggggaacctcatatgatcgtctccaagcaagaaaggggaaaatctctgctatttaagacctcagccggtgttaacatgtgcaccctcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaaacagatccagaaggtggaaacttgggctctgaggcaccctggattcaccgttattgcactgtttctcgcccatgctatcggcacatcgattacccagaagggcatcatattcatcttactgatgcttgtgacgccatcaatggccatgcggtgcgtcgggattggaaaccgcgattttgtggagggtttgagcggcgcgacttgggtagacgttgtgctggagcacgggagttgtgtcacaaccatggccaagaataagcccactctagatatcgaactcctgaaaacagaggtgaccaaccctgccgtgcttagaaagctgtgcattgaagctaaaatctccaatacgaccacagactctaggtgtccaactcaaggagaggccaccttggtcgaagaacaggatgcaaacttcgtttgccggcgcacatttgtggaccgaggctggggtaatgggtgtggactcttcggcaagggcagcctgttaacttgcgctaagtttaaatgcgtaaccaagctggaggggaaaatagtgcagtacgaaaacctcaagtattccgtcattgtgacagttcacaccggagatcagcatcaagtgggtaatgagactacggaacacggcacaatcgccaccattactccccaggcgcctacctcagagatccagcttacagactacggggccctgaccttggactgtagtccaagaactggactagatttcaacgaaatggtcctgctcacaatgaaagaaaagagctggctggtgcataaacagtggtttcttgacctgccgttgccctggacgtctggcgcatccacctcacaagagacttggaataggcaggatctcctggtaacattcaagaccgctcacgccaagaaacaggaagttgtggtcttaggtagccaagagggggctatgcacacagccctgactggcgcaaccgaaatccagacgagtggaaccacaactatttttgccggccatctaaagtgccggctcaaaatggacaagctgacccttaaagggatgtcttatgtgatgtgtacaggatccttcaagttggagaaggaagtcgctgagactcagcacggtaccgtgctggttcaggtgaaatacgagggcacggatgcgccttgcaagataccattcagcacacaagacgaaaaaggggtaacccagaacggacgtctcatcactgcaaatcccattgtcacagataaggagaaacctgtgaacatcgaaaccgagccaccctttggcgagtcgtatatagttgtgggtgccggggaaaaggctctgaaactttcttggttcaaaaagggctcctcaattggaaaaatgtttgaggccactgcacgcggcgccagaaggatggctatcctgggggacaccgcctgggatttcggaagtatcggtggcgtctttacaagcgtggggaagttggtacatcaggtgttcggaacggcatacggcgttctcttttccggtgtctcttggaccatgaaaattgggatcggcattctgttaacttggctgggactaaatagccggtcaacaagtctctccatgacctgtatagtggtgggcatggtcacactgtaccttggggttatggtgcaggcggacagcggatgcgtgatcaactggaagggccgagaattgaagtgtggttctgggattttcgtaactaacgaggtccacacctggacggaacaatataaatttcaggctgattcaccgaagcgcctgagtgccgcaatcggacgagcatgggaggagggcgtgtgcggtatcaggagcgctacacggctcgaaaatattatgtggaaacagatatccaacgagctgaatcatatcttactggaaaacgacattaagttcaccgttgtggtcggcaatgccaacgggatccttgcacagggcaaaaagatgattcgccctcaacccatggagcacaaatactcttggaagtcgtggggcaaggctaaaatcataggggccgacatccagaatactacctttattatcgatggaccagacacacctgaatgtcccgatgagcagagagcgtggaacatttgggaggtggaagactatggcttcggtatctttactaccaatatatggttgaagctcagggatagctacacacagatgtgcgaccaccgtctgatgtccgccgctattaaagattcaaaggcagttcatgccgacatggggtattggatcgagagtgagaaaaacgagacgtggaagctagctcgggcctctttcattgaagtgaagacctgtatctggccaaaaagccacactctgtggtccaatggagtactcgagtcagagatgataatccccaagatgtacggcggtcctattagccaacataactatcgaccaggctacttcacacagaccgcagggccgtggcacctgggaaaacttgaattggattttgacctgtgcgagggcactacagtcgtggtggatgaacactgcgggtctagaggaccctccttaaggaccacgactgtcaccggcaagatcattcatgagtggtgttgccgcagttgtacactccctccactgcggttcagaggtgaggacgggtgctggtacggaatggaaatcaggcccgttaaagagaaggaagagaatcttgtgcgcagcatggtatctgcgggctccggtgaagtggattcatttagtctgggcatattgtgtgtcagcattatgatcgaggaggtgatgcgatcgcggtggtcccgtaagatgctcatgaccgggactctggccgttttcctactgctcatcatgggacagctgacatggaacgaccttattagattgtgcatcatggtgggcgctaatgcctctgacaaaatggggatgggaaccacatatctggcattaatggctacttttaagatgaggcctatgttcgccgtcggcctcctgtttcgccggcttaccagcagagaagtgctgctactcacgattggtctgtcattggttgcaagtgtggagctgccaaactccttagaggaactcggggatggactggccatgggcataatgatgcttaaactgttgacagagttccaaccccaccagctctggaccactctgctatctctgacctttatcaagacaactcttagcctcgactacgcttggaaaaccacggcgatggtcctgtccattgtatcattgttcccgctgtgtttaagcacaaccagtcagaagactacatggctccctgtgctgcttggctcttttgggtgcaagccactgaccatgttcttgatcactgagaacgagatttggggaaggaaatcctggcccctcaatgaaggtatcatggccgttggcatagtgagcatcctgctatcgtcactgcttaagaacgatgtccctctcgcagggcccctgattgctggaggcatgttgatcgcctgttatgtgatttctggtagttccgccgacttaagcctggagaaagctgcagaagtatcttgggaggaagaggccgagcatagcgggacatcccacaatatcctcgtggaagtccaggatgacggaaccatgaagataaaagatgaggaacgagacgatacgctgactattcttctgaaggcgaccttgctagctgtttcaggcgtgtacccaatgagtatccctgccacactgtttgtgtggtatctctggcagaaaaagaagcagcgcagcggcgtcctgtgggacaccccctctccaccggaggtggagcgggcagttcttgatgacgggatctacagaattttacagaggggactgctcggtcgttcccaggtaggcgtgggggtcttccaagatggagtgttccatacaatgtggcacgttactcgcggcgccgtgttgatgtatcagggtaaacggctggaaccttcatgggctagtgtcaagaaagacctcataagctacgggggaggctggagatttcagggctcctggaacaccggggaggaagtgcaggtaatcgcagtcgagcccggaaagaatcccaaaaacgtgcaaacgacacccggtactttcaagacccctgaaggcgaggttggggccattgcgctggactttaagccaggaacatctggctcgcccatcgtgaatagggagggtaaaattgtcgggctttacggaaacggcgtggttaccactagcggcacctatgtgtcagctatcgcccaggcaaaggcctcccaggaagggcctctgccggagatagaagatgaggtcttcaaaaagcgaaatttgacaatcatggacctacacccaggaagtggtaaaacgcggcgctacctgcccgctattgtgagagaagccatcaagaggaagctccggactttaattctggcacctacccgagtagtggcttctgagatggccgaggcgcttaaaggcatgccaatcagatatcaaacaaccgccgttaagagcgaacatactgggcgcgagatagtcgatctgatgtgccacgcaacatttaccatgaggctcttgtcccccgtgcgtgtgcctaactacaatatgattatcatggacgaagctcatttcacggatccggcctcaatcgctgcacggggatatatttctactagagtcggcatgggtgaggccgccgctatctttatgacagcgacacccccagggagcgtagaagcattccctcagagtaacgccgtgatacaggacgaggagagggatattcccgaacgctcctggaatagcggatacgactggatcaccgattttccaggcaaaactgtttggttcgtgccttctattaagtcaggcaacgacatcgctaattgtctgcggaaaaacgggaagagagtcatacagctctccagaaagacatttgataccgagtatcagaaaactaagaacaatgactgggactacgtggttactacggatattagtgaaatgggagccaacttcagggcagaccgcgtgatcgatccccgtagatgcctgaaaccagtcatccttaaggacggtccggagcgggtgattctagccggccctatgcccgtaaccgtggctagcgcggcccaaaggcgcgggcgaatcggaagaaatcagaacaaagagggcgatcagtacgtttatatgggtcaaccactgaataacgacgaagatcacgcacattggacagaggctaagatgttgttagacaatattaacactcccgaagggataatccctgccctgttcgagccagaacgggagaagtcggcagccattgatggcgagtacaggctccgcggagaagctagaaaaacctttgtcgagctgatgaggcggggcgaccttcccgtgtggctgtcttataaggtggcctccgaagggttccagtacagcgatcgtcgctggtgctttgacggagagcgaaataaccaggtcctcgaagagaatatggatgttgagatctggacaaaagaaggtgagagaaagaaattgaggcctcggtggctggacgcgcgcacctattcagacccgctagcactgagagagttcaaggagtttgccgctggcaggcggagtgtgtctggggatctcatccttgaaattggaaaactgccacagcacttaactttgcgagcccaaaacgctctggacaatctcgtaatgctgcacaactccgagcagggcggtaaggcatacagacatgccatggaggaacttcccgatacgatagagaccctgatgctcttggctctgatcgccgtgttaacagggggcgtcactctattctttctgagcggaaagggcctcgggaaaacctcaattggacttctgtgtgtgacagcaagtagcgcgttgctgtggatggcctccgttgaacctcactggatcgctgcctctattatcctcgagttctttctgatggtgcttctcatacccgagccagaccgccagaggacccctcaggataatcaactggcatatgtcgtaatcggtttgctgttcatgattttaactgtggctgccaacgaaatgggcctactggagacaacgaagaaagacctcgggatcggacatgttgcagccgaaaaccaccagcacgctaccatgcttgatgtggacctgcatcccgcgagcgcctggactttgtacgcagtcgctacaaccgtgattaccccaatgatgcggcacacaatcgagaatactacggccaacatatccctgaccgccattgcaaatcaggctgccatcctcatgggcctggataagggttggcctatttcaaaaatggaccttggggtcccgttactggcgctcggctgctactctcaagtgaaccccttgacactgactgctgccgttctaatgctggtggcacattatgccatcataggaccaggcctccaggctaaggcaacccgtgaagcccagaagagaacagcggctgggatcatgaaaaatcctaccgtagatggaattgtggccatcgaccttgatcccgtcgtttacgacgcaaagtttgagaaacagctgggccaaattatgttgctgatcctctgtacgagtcagatactgttaatgaggactacatgggccctttgcgagtcgattaccctggctactggtccactcaccacactatgggaagggagccctggaaagttctggaacactaccatcgccgtgtccatggcaaatatctttcgcggctcttatctggctggtgccggcttggcgttctcactgatgaaaagcctcgggggaggccggcgagggacaggagcccagggcgagacgcttggtgaaaagtggaagagacagctgaaccaattgtccaaaagtgagttcaatacctacaagaggtctgggattatggaagtcgaccgcagcgaggcaaaagagggactgaagcggggcgaaactacaaaacacgctgtgtcaagaggtaccgccaagctccgttggtttgtagagaggaacttagtgaagcccgaaggcaaagttatcgatctggggtgtggacggggcgggtggtcctattactgcgcaggacttaagaaagtgactgaggtcaagggctatacaaaaggtgggccgggacatgaagaaccaatacctatggctacctacggctggaatctggtgaagctacacagtggcaaagacgtcttctttatgcccccagagaagtgtgatacgctcctgtgcgacattggggaaagctctcccaaccctaccatcgaggaaggacgcacattgcgagtgctgaagatggttgagccgtggctcagaggtaatcagttctgtattaaaatccttaacccctacatgccatccgtagtggagactctggaacagatgcagaggaagcacggcgggatgttagtccggaatcctctgtcacgcaacagcacccatgagatgtattgggtgtcgtgcggaacaggcaatatagtttctgccgtgaacatgacaagtagaatgttgctcaacaggtttaccatggcccaccgaaaacccacatacgaacgggatgtcgacctgggtgcggggacccgtcatgtggctgtagagcctgaagtggcaaatctagatatcattggacaaagaatcgagaacattaagaatgagcacaaatccacttggcactatgacgaagataacccatacaagacgtgggcctatcatggcagctacgaggttaagccctcaggctccgcttctagcatggtcaatggggtggtgcgccttctgacaaaaccttgggacgtcatcccaatggttacccagattgccatgactgataccacacccttcggacagcaaagggtgtttaaggaaaaagtagacacgcggaccccgagagcaaagcgcggtactgcccagatcatggaggtgacagctaaatggctctggggcttcctgagtaggaacaagaagcctcgaatatgtacccgggaagagtttactagaaaagtcaggtccaatgcggccattggggcagtgttcgttgacgagaaccagtggaatagcgctaaggaagccgtggaggatgaacgcttttgggacttggtccaccgtgagcgggaactgcataaacagggaaagtgcgcaacatgcgtgtataacatgatgggcaaaagagagaagaagctcggtgagttcgggaaagccaagggatctagggctatctggtacatgtggcttggcgcccgctttctggagttcgaggcgttaggcttcatgaatgaagatcactggttttcacgagagaacagtctgtccggggtagagggagaaggtttgcataaactcggctacatcctgcgggacattagcaagataccagggggaaatatgtatgcagatgacaccgccggctgggatacaagaatcactgaggacgatctaaggaacgaagctaaaattaccgacatcatggagcccgaacacgcccttctggcaacgtctattttcaagctcacctaccaaaataaagttgtgcgcgtccagagacctgctaagaacggtacagtgatggatgtgatctcgcggagggaccagcgtgggtcaggacaggtcggcacttatggcctgaacacctttacaaatatggaggttcaattgatacgacagatggagagcgaagggatcttctttccatccgagttagaaagtcccaacctggccgagcgcgtgctcgattggcttgaaaagcacggagctgagagactgaaacggatggccatttctggtgacgactgtgtagtgaagccgatcgatgacaggttcgcaactgcgctaattgccctgaatgatatgggcaaagtccgcaaggacatccctcagtgggagcccagcaaagggtggaacgattggcagcaagtgccattttgctcccatcacttccatcagctcataatgaaggacggaagagaaattgttgtgccttgtcggaatcaggatgagttggtcggcagggctcgagtgtcacagggtgccgggtggagtctgcgtgaaaccgcatgccttggaaagtcttacgctcaaatgtggcagctgatgtattttcacagacgcgacctccggttagccgcaaacgccatctgtagcgcggtacccgttgattgggtgccaacgtccaggacaacctggtcaatccacgctcatcaccagtggatgactacagaggacatgctgagcgtctggaatagagtgtggattgaagagaacccctggatggaggataaaacccatgtttcttcctgggaagaggtgccttacttgggcaagcgcgaagaccaatggtgcggcagtctgatagggctcactgcccgggcaacctgggccacaaatatccaggtcgctattaaccaggtgaggcgacttatcggaaatgagaactatctggactacatgacgagcatgaaaagattcaagaatgagtcggatccagaaggtgccctatggtga

SEQ ID NO: 13200 - RNA, 9879 nt, synthetic construct
  misc_feature 1..9879: note = derived and/or modified CDS sequence (opt3) from DENV-1__JX669471__SS-prME
  source 1..9879: mol_type = other RNA
agcgtgaccatgctgctcatgcttctgccaactgcattggctttccacttaactacgagaggaggggagcctcatatgatcgtctccaagcaagaaaggggaaaatctctgctgtttaagacctcagccggtgttaacatgtgcacactcattgccatggacctgggcgagctttgtgaagatactatgacctacaaatgcccacggataaccgaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaaacagatccagaaggtggaaacttgggctctgaggcaccctggattcaccgttattgcactgtttctcgcccatgctatcggcacatcgattacccagaagggcatcatattcatcttactgatgcttgtgacgccatcaatggccatgcggtgcgtcgggattggaaaccgcgattttgtggagggtttgagcggcgcgacttgggtagacgttgtgctggagcacgggagttgtgtcacaaccatggccaagaataagcccactctagatatcgaactcctgaaaacagaggtgaccaaccctgccgtgcttagaaagctgtgcattgaagctaaaatctccaatacgaccacagactctaggtgtccaactcaaggagaggccaccttggtcgaagaacaagatgcaaacttcgtttgccggcgcacatttgtggaccgaggctggggtaatgggtgtggactcttcggcaagggcagcctgttaacttgcgctaagtttaaatgcgtaaccaagctggaggggaaaatagtgcagtacgaaaacctcaagtattccgtcattgtgacagttcacaccggagatcagcatcaagtgggtaatgagactacggaacacggcacaatcgccaccattactccccaggcgcctacctcagagatccagcttacagactacggggccctgaccttggactgtagtccaagaactggactagatttcaacgaaatggtcctgctcacaatgaaagaaaagagctggctggtgcataaacagtggtttcttgacctgccgttgccctggacgtctggcgcatccacctcacaagagacttggaataggcaggatctcctggtaacattcaagaccgctcacgccaagaaacaggaagttgtggtcttaggtagccaagagggggctatgcacacagccctgactggcgcaaccgaaatccagacgagtggaaccacaactatttttgccggccatctaaagtgccggctcaaaatggacaagctgacccttaaagggacatcttatgtgatgtgtactggatccttcaagttggagaaggaagtcgctgagacccagcacggtacggtgctggttcaggtgaaatacgagggcacagatgcgccttgcaagataccattcagcacccaagacgaaaaaggggtaactcagaacggacgtctcatcacagcaaatcccattgtcaccgataaggagaaacctgtgaacatcgaaactgagccaccctttggcgagtcgtatatagttgtgggtgccggggaaaaggctctgaaactttcttggttcaaaaagggctcctcaattggaaaaatgtttgaggccaccgcacgcggcgccagaaggatggctatcctgggggacacagcctgggatttcggaagtatcggtggcgtctttacgagcgtggggaagttggtacatcaggtgttcggaaccgcatacggcgttctcttttccggtgtctcttggactatgaaaattgggatcggcattctgttaacatggctgggactaaatagccggtcaaccagtctctccatgacatgtatagcggtgggcatggtgactctgtaccttggggtcatggttcaggctgacagcggatgcgtgatcaactggaagggccgagaattgaagtgtggttctgggattttcgtgaccaacgaggtacacacgtggacagaacaatataaatttcaggccgattcaccgaagcgcctgagtgcagccatcggacgagcttgggaggagggcgtctgcggtatcaggagcgccacccggctcgaaaatattatgtggaaacagatatccaacgagctgaatcatatcttactggaaaacgacattaagttcactgtggttgtgggcaatgcaaacgggatccttgctcagggcaaaaagatgattcgccctcaacccatggagcacaaatactcttggaagtcgtggggcaaggccaaaatcataggggcggacatccagaataccacatttattatcgatggaccagacactcctgaatgtcccgatgagcagagagcctggaacatttgggaggtcgaagactatggcttcggtatctttaccacaaatatatggttgaagctcagggatagctacacgcagatgtgcgaccaccgtctgatgtccgctgcaattaaagattcaaaggccgtgcatgctgacatggggtattggatcgagagtgagaaaaacgagacctggaagctagcccgggcatctttcattgaagttaagacttgtatctggccaaaaagccacacactgtggtccaatggagtgctcgagtcagagatgataatccccaagatgtacggcggtcctattagccaacataactatcgaccaggctacttcacccagactgcggggccgtggcacctgggaaaacttgaattggattttgacctgtgcgagggcacaaccgtagtcgtggatgaacactgcgggtctagaggaccctccttaaggacgactaccgtgacaggcaagatcattcatgagtggtgttgccgcagttgtaccctccctccactgcggttcagaggtgaggacgggtgctggtacggaatggaaatcaggcccgtcaaagagaaggaagagaatcttgttcgcagcatggtgtctgccggctccggtgaagtagattcatttagtctgggcatattgtgtgtgagcattatgatcgaggaggtcatgcgatcgcggtggtcccgtaagatgctcatgactgggacactggctgtgttcctactgctcatcatgggacagctgacctggaacgaccttattagattgtgcatcatggttggcgccaatgcatctgacaaaatggggatgggaacaacttatctggctttaatggccaccctcaagatgaggcctatgtttgcagtgggcctgcttttccgccggctgacgagcagagaagtcctactcctgacaattggtttgtcactggtggccagtgttgagttaccaaactccctcgaggaactgggggatggacttgctatgggcataatgatgctgaaattgctcaccgaatttcaaccccaccagctgtggactaccctactgtctcttacattcatcaagactaccctcagcctggactacgcgtggaaaacgacagccatggtgttgtccattgtctcactgtttccgttatgtctcagcaccacaagtcagaagacaacctggctgcctgtacttctgggctctttcgggtgcaagccattgactatgtttctcatcacagagaacgagatttggggaaggaaatcctggcccctgaatgaaggtatcatggcaataggcatcgtgagcattctactgtcgtcacttctcaagaacgatgttcctctggctgggcccttgatcgccggaggcatgttaattgcctgttatgtgatctctggtagttccgctgacctgagcctcgagaaagcagccgaagtctcttgggaggaagaggcggagcatagcgggacctcccacaatatactggtggaagtacaggatgacggaacgatgaagattaaagatgaggaacgagacgatactcttaccatcctgttgaaggctacactactggccgtgtcaggcgtctacccaatgagtatccctgcaaccctcttcgtttggtatttttggcagaaaaagaagcagcgcagcggcgtgctgtgggacacaccctctccaccggaggtggagcgggccgtccttgatgacgggatttacagaatattacagaggggactgctcggtcgttcccaggtgggcgttggggtattccaagatggagtgttccatactatgtggcacgtcacccgcggcgctgtgttgatgtatcagggtaaacggctggaaccttcatgggcaagtgttaagaaagacctcatcagctacgggggaggctggagatttcagggctcctggaacacgggggaggaagtgcaggtcattgccgtggagcccggaaagaatcccaaaaacgtacaaacaactcccggtaccttcaagacacctgaaggcgaggtcggggcgatcgctctggactttaagccaggaacctctggctcgcccattgtgaatagggagggtaaaatcgttgggctttacggaaacggcgtggtcactaccagcggcacatatgtgtcagccatagcacaggccaaggcttcccaggaagggcctctgccggagatcgaagatgaggttttcaaaaagcgaaatttgacgattatggacctacacccaggaagtggtaaaactcggcgctacctgcccgccatcgtgagagaagcaattaagaggaagctccggaccttaatcctggctcctacacgagtcgtggcctctgagatggcggaggcccttaaaggcatgccaataagatatcaaaccactgcagtaaagagcgaacatacagggcgcgagattgtggatctgatgtgccacgctacctttacgatgaggctcttgtcccccgttcgtgtccctaactacaatatgatcatcatggacgaagcccatttcactgtgccggcttcaattgcagcccggggatatatctctacaagagtgggcatgggtgaggccgctgcgatatttatgaccgcaacacccccagggagcgtcgaagccttccctcagagtaacgctgtaattcaggatgaggagagggacatccccgaacgctcctggaatagcggatacgattggattactgactttccaggcaaaacagtgtggttcgttccttctatcaagtcaggcaacgatatagccaattgtctgcggaaaaacgggaagagagtgattcagctctccagaaagacctttgacacagagtatcagaaaactaagaacaatgattgggactacgtcgtgacgaccgacatcagtgaaatgggagcaaacttcagggccgatcgcgttatcgacccccgtagatgcctgaaaccagtgattcttaaggatggtccggagcgggtcatcctagctggccctatgcccgtgacagtagcgagcgccgcacagaggcgcgggcgaattggaagaaatcagaacaaagagggcgaccagtacgtgtatatgggtcaaccactgaataacgatgaagaccacgctcattggactgaggccaagatgttgttagataatataaacacccccgaagggatcattcctgcactgttcgagccagaacgggagaagtcggccgctatcgacggcgagtacaggctccgcggagaagccagaaaaacatttgttgagctgatgaggcggggcgatcttcccgtctggctgtcttataaggtggcgtccgaagggttccagtacagcgaccgtcgctggtgctttgatggagagcgaaataaccaggtgctcgaagagaatatggacgtcgagatctggaccaaagaaggtgagagaaagaaattgaggcctcggtggctggatgcacgcacttattcagacccgctagccctgagagagttcaaggagtttgctgccggcaggcggagtgtttctggggacctcattcttgaaataggaaaactgccacagcacttaacgcaacgagctcagaacgcattggataatctggtgatgctccacaactccgagcagggcggtaaggcctacagacatgctatggaggaactgcccgacaccatcgagacacttatgctgctcgccttgattgcagtactgactgggggcgtgaccttattctttctaagcggaaagggcctggggaaaacatcaatcggactcctttgtgtcaccgcgagtagcgccctgttgtggatggcttccgtggaacctcactggattgccgcatctatcatactggagttctttctcatggttctgcttatccccgagccagatcgccagaggactcctcaagacaatcagctcgcttatgtggtcattggtctgttgttcatgatcctgacagtagccgcaaacgaaatgggcttactagagacgaccaagaaagatctggggattggacatgtggccgctgaaaaccaccagcacgcgactatgctcgacgttgatcttcatcccgccagcgcatggacactgtacgctgtggccaccaccgtcatcacaccaatgatgcggcacactatagagaatacgaccgccaacatttccttgacagcaatcgctaatcaagccgcgattctgatgggcctcgacaagggttggcctatctcaaaaatggatctgggggtgccgcttttagctctgggctgctactctcaggtcaaccccctcactttgaccgccgcagtgctgatgctagttgcccattatgctataatcggaccaggcctgcaggcaaaggccacacgtgaagcgcagaagagaaccgctgccgggattatgaaaaatcctactgtggacggaatcgtagcaattgatctcgaccccgtggtctacgatgccaagtttgagaaacaacttggccagatcatgctgttgatactgtgtacgagtcagattctcctgatgaggacaacctgggctttatgcgagtcgatcactcttgccaccggtccactgacaactctctgggaagggagccctggaaagttctggaacaccacaatcgcagtttccatggctaatatttttcgcggctcttatctagccggtgcgggcctggccttctcattgatgaaaagcctagggggaggccggcgagggacgggagcacagggcgagaccctcggtgaaaagtggaagagacaacttaaccagctgtccaaaagtgagttcaatacttacaagaggtctgggatcatggaagtggaccgcagcgaggctaaagagggattgaagcggggcgaaacaaccaaacacgccgtctcaagaggtactgcaaagctgcgttggtttgtggagaggaacctcgtaaagcccgaaggcaaagtgatagacttagggtgtggacggggcgggtggtcctattactgcgctggactgaagaaagttacagaggtgaagggctataccaaaggtgggccgggacatgaggaaccaattcctatggccacgtacggctggaatcttgtcaagctgcacagtggcaaagatgtgttctttatgcccccagagaagtgtgacaccctactctgcgatatcggggaaagctctcccaaccctacaattgaggaaggacgcactctgcgagtcttgaagatggtggagccgtggctgagaggtaatcagttctgtatcaaaatactcaacccctacatgccatccgttgtagagacccttgaacagatgcaaaggaagcacggcgggatgctggtgcggaatcctttatcacgcaacagcacacatgagatgtattgggtctcgtgcggaactggcaatatcgtgtctgccgttaacatgaccagtagaatgctgttgaacaggtttacaatggcgcaccgaaaacccacctacgaccgggatgtggacctcggtgctgggactcgtcatgtcgcagtggaacctgaggtagccaatctggatattatcggacagagaattgaaaacatcaagaatgagcacaaatccacgtggcactatgacgaggataacccatacaagacatgggcttatcatggcagctacgaagtgaagccctcaggctccgcctctagcatggttaatggggtcgtgcgcctacttaccaaaccttgggacgtgattccaatggtcactcagatcgcaatgaccgatacaacgcccttcggacaacagagggtttttaaggagaaagtggacacccggactccgagagccaagcgcggtacagctcagataatggaagtaaccgcgaaatggctgtggggcttcctcagtaggaacaagaagcctcgaatttgtactcgggaggaatttacaagaaaagtgaggtccaatgccgcaatcggggctgtcttcgtggacgagaaccagtggaatagcgccaaggaggcagttgaagatgagcgcttttgggacctggtgcaccgtgaacgggagttgcataaacaaggaaagtgcgcaacctgcgtctataacatgatgggcaaaagagaaaagaagctgggtgagttcgggaaagctaagggatctagggccatctggtacatgtggctcggcgcgcgctttcttgagttcgaagcactgggcttcatgaatgaggatcactggttttcacgagaaaacagtttatccggggtggagggagagggtctgcataaattgggctacattctccgggacataagcaagatcccagggggaaatatgtatgccgatgacacagctggctgggatactagaattaccgaagacgatctgcagaacgaggccaaaatcacggacattatggaacccgagcacgcactacttgctacctctatcttcaagctgacataccagaataaagtagttagggtgcagcgccctgccaagaacggtactgtcatggatgtgatatcgagacgggaccaaagggggtcaggacaggtgggcacctatggcctcaacacatttactaatatggaagtccagctgatccgtcagatggagagcgaggggattttctttccatccgaattggagagtcccaacttagctgaacgagttctggattggctcgagaagcacggagccgaacgccttaaaagaatggcaatctctggtgacgactgtgtggtaaagccgattgatgaccggttcgcgaccgccctgatcgctctaaatgatatgggcaaagtgaggaaggacatacctcaatgggagcccagcaaagggtggaacgattggcagcaggtcccattttgctcccatcacttccatcagctgattatgaaggacggacgcgagatcgtggttccttgtagaaatcaagatgaactcgtgggccgggccagggtctcacagggtgcagggtggagtttgcgagagacggcttgcctgggaaagtcttacgcccagatgtggcaacttatgtattttcaccgtagagacctgcgcctcgcagccaacgcgatctgtagcgctgtgcccgtagattgggttccaacatcccggaccacttggtcaattcacgcccatcaccagtggatgacaaccgaagacatgttaagcgtgtggaatagggtctggatagaggaaaacccctggatggaggataaaactcatgtgtcttcctgggaggaagttccttacctgggcaagagagaggaccagtggtgcggcagtttgatcgggctgaccgcacgcgccacatgggctacgaatattcaggtggccatcaaccaagtccggaggctcattggaaatgaaaactatcttgactacatgaccagcatgaaacgattcaagaatgagtcggatccagagggtgcactgtggtga

SEQ ID NO: 13201 - RNA, 9879 nt, synthetic construct
  misc_feature 1..9879: note = derived and/or modified CDS sequence (opt3) from DENV-1__JX669472__SS-prME
  source 1..9879: mol_type = other RNA
agcgtgaccatgctgctcatgcttctgcccacagcattggctttccacttaactacgagaggaggggaacctcatatgatcgtctccaagcaggaaaggggaaaatctctgctgtttaagacctcagccggtgttaacatgtgcacactcattgcaatggacctgggagaactttgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaaacagatccagaaggtggaaacttgggctctgaggcaccctggattcaccgttattgcactgtttctcgcccatgctatcggcacatcgattacccagaagggcatcatattcatcttactgatgcttgtgacgccatcaatggccatgcggtgcgtcgggattggaaaccgcgattttgtggagggtttgagcggcgcgacttgggtagacgttgtgctggagcacgggagttgtgtcacaaccatggccaagaataagcccactctagatatcgaactcctgaaaacagaggtgaccaaccctgccgtgcttagaaagctgtgcattgaagctaaaatctccaatacgaccacagactctaggtgtccaactcaaggagaggccaccttggtcgaagaacaagatgcaaacttcgtttgccggcgcacatttgtggaccgaggctggggtaatgggtgtggactcttcggcaagggcagcctgttaacttgcgctaagtttaaatgcgtaaccaagctggaggggaaaatagtgcagtacgaaaacctcaagtattccgtcattgtgacagttcacaccggagatcagcatcaagtgggtaatgagactacggaacacggcacaatcgccaccattactccccaggcgcctacctcagagatccagcttacagactacggggccctgaccttggactgtagtccaagaactggactagatttcaacgaaatggtcctgctcacaatgaaagaaaagagctggctggtgcataaacagtggtttcttgacctgccgttgccctggacgtctggcgcatccacctcacaagagacttggaataggcaggatctcctggtaacattcaagaccgctcacgccaagaaacaggaagttgtggtcttaggtagccaagagggggctatgcacacagccctgactggcgcaaccgaaatccagacgagtggaaccacaactatttttgccggccatctaaagtgccggctcaaaatggacaagctgacccttaaagggacatcttatgtgatgtgtactggatccttcaagttggagaaggaagtcgctgagacccagcacggtacggtgctggttcaggtgaaatacgagggcacagatgcgccttgcaagataccattcagcacccaagacgaaaaaggggtaactcagaacggacgtctcatcacagcaaatcccattgtcaccgataaggagaaacctgtgaacatcgaaactgagccaccctttggcgagtcgtatatagttgtgggtgccggggaaaaggctctgaaactttcttggttcaaaaagggctcctcaattggaaaaatgtttgaggccaccgcacgcggcgccagaaggatggctatcctgggggacacagcctgggatttcggaagtatcggtggcgtctttacgagcgtggggaagttggtacatcaggtgttcggaaccgcatacggcgttctcttttccggtgtctcttggactatgaaaattgggatcggcattctgttaacatggctgggactaaatagccggtcaaccagtctctccatgacatgtatagcggtgggcatggtgactctgtaccttggggtcatggttcaggctgacagcggatgcgtgatcaactggaagggccgagaattgaagtgtggttctgggattttcgtgaccaacgaggtacacacgtggacagaacaatataaatttcaggccgattcaccgaagcgcctgagtgcagccatcggcagagcttgggaggagggcgtctgcggtatcaggagcgccacccggctcgaaaatattatgtggaaacagatatccaacgagctgaatcatatcttactggaaaacgacatgaagttcactgtggttgtgggcaatgcaaacgggattcttgctcagggcaagaagatgatcaaacctcaacccatggagcacaagtactcttggaagtcgtggggcaaagccaagattatcggggcggacatacagaataccacatttatcattgatggaccagacactcctgaatgtcccgatgagcagcgcgcctggaacatctgggaggtcgaagactatggcttcggtatttttaccacaaatatctggttgaaactcagagatagctacacgcagatgtgcgaccacaggctgatgtccgctgcaataaaggattcaaaagccgtgcatgctgacatggggtattggattgagagtgaaaagaacgagacctggaagctagcccgtgcatctttcatcgaagttaaaacttgtatttggccaaagagccacacactgtggtccaatggagtgctcgagtcagagatgatcatacccaaaatgtacggcggtcctatcagccaacataactatcggccaggctacttcacccagactgcggggccgtggcacctgggaaaacttgaattggattttgacctgtgcgagggcacaaccgtagtcgtggatgaacactgcgggtctcgaggaccctccttaagaacgactaccgtgacaggcaaaattatccatgagtggtgttgcaggagttgtaccctccctccactgcgcttccggggtgaggacgggtgctggtacggaatggaaattagacccgtcaaggagaaggaagagaatcttgttaggagcatggtgtctgccggctccggtgaagtagattcatttagtctgggcatcttgtgtgtgagcataatgattgaggaggtcatgcgctcgcgatggtcccggaaaatgctcatgactgggacactggctgtgttcctactgctcatcatgggacagctgacctggaacgaccttatccgtttgtgcattatggttggcgccaatgcatctgacaagatggggatgggaacaacttatctggctttaatggccacctttaaaatgagacctatgttcgcagtgggcctcctgtttaggcgccttacgagccgggaagtcctgctactcacaatcggtctgtcattggtggccagtgttgagctgccaaactccttagaggaactcggggatggactggctatgggcattatgatgcttaagctgttgaccgagttccaaccccaccagctctggactaccctgctatctctgacatttataaaaactacccttagcctcgactacgcgtggaagacgacagccaccgtgctgtccatcgtctcattgttcccgctgtgtttaagcactacaagtcagaagaccacttggctccctgtactgcttggctcttttgggtgcaaaccactgacaatgttcttgattaccgagaacaagatctggggaagaaaatcctggcccctcaatgagggtattatggcaatcggcatagtgagcatcctgctatcgtcactgcttaagaacgatgttcctctcgctgggcccctgattgccggaggcatgttgatcgcctgttatgtgatttctggtagttccgctgacttaagcctggaaaaagcagccgaggtctcttgggaagaggaagcggagcatagcgggacgtcccacaatatcctcgtggaggtacaggatgacggaactatgaagataaaagatgaagagagggacgataccctgacaattcttctgaaggctaccttgctagccgtgtcaggcgtctacccaatgagtatccctgcaacactgtttgtttggtatttctggcaaaagaaaaagcagcgaagcggcgtgctctgggacactccctctccaccggaagtggagcgcgccgtcctggatgacgggatctaccggattcttcagagaggattactgggtaggtcccaggtgggcgttggggtattccaagatggagtgtttcataccatgtggcacgtcacgcgtggcgctgtgctcatgtatcagggtaaacgcttggagccttcatgggcaagtgttaagaaagacctgataagctacgggggaggctggcggttccagggctcctggaacacaggggaagaggtgcaggtcatcgccgtggaacccggaaagaatccaaagaacgtacaaactacccccggtacatttaaaacccctgagggcgaagtcggggcgattgctctcgacttcaagccaggaacttctggctcgcccatcgtgaatagagagggtaaaattgttgggctgtacggaaacggcgtggtcaccacaagcggcacgtatgtgtcagccatcgcacaggccaaggcttcccaggaggggcctcttccggaaatagaggatgaagtttttaaaaagaggaatctgactatcatggacttgcacccaggaagtggtaagacccgacggtacctacccgccattgtgcgcgaggcaatcaaaagaaagctgaggacactcattttagctcctacccgggtcgtggcctctgaaatggcggaggccctgaaaggcatgccaatccgatatcaaactacagcagtaaagagcgagcataccgggagagaaatagtggatcttatgtgccacgctacgttcactatgcgcctgctctcccccgttagggtccctaactacaatatgattatcatggacgaggcccattttacagatccggcttcaatcgcagcccgtggatatatttctacccgggtgggcatgggtgaagccgctgcgatcttcatgaccgcaactcccccagggagcgtggaggcctttcctcagagtaacgctgtcatacaggacgaagagagagatattcccgagaggtcctggaatagcggatacgactggatcacagatttcccaggcaaaaccgtatggtttgtgccttctattaagtcaggcaacgacatcgccaattgtttgcgcaagaacgggaaacgagttatacagctgtccagaaagacattcgatactgaatatcagaagacgaagaacaatgactgggactacgtggtcaccacagatattagtgagatgggagcaaacttccgggccgacagggtgatcgatccccgccgttgcctcaaaccagttatcctgaaggacggtccggaaagagtgattcttgctggccctatgcccgtcactgtggcgagcgccgcacagcggagggggcgcatcggacgaaatcagaacaaggagggcgatcagtacgtatatatgggtcaaccactaaataacgacgaggatcacgctcattggaccgaagccaaaatgctgttggacaatattaacacacccgaggggataatccctgcattatttgaaccagagagagaaaagtcggccgctattgatggcgagtaccggctgaggggagaggcccgcaaaaccttcgtggaactcatgagaaggggcgacctgcccgtttggctttcttataaggtcgcgtccgaggggtttcagtacagcgatcggcgttggtgcttcgacggagaacgcaataaccaggtgctggaggaaaatatggatgtggagatctggactaaagagggtgaacgaaagaaactcagacctaggtggttggacgcacggacgtattcagacccgctggccctacgcgagtttaaggagttcgctgccggcagaaggagtgtctctggggatctgatcctcgagattggaaaacttccacagcacctgaccttacgggctcaaaacgcattggacaatctggttatgctccacaactccgaacagggcggtaaagcctaccgacatgctatggaggagctgcccgatacaatagaaactcttatgctgctcgccttgatcgcagtgctgaccgggggcgtaacattatttttcctaagcggaaagggcctggggaaaacctcaattggactcctttgtgtgactgcgagtagcgccctgttgtggatggcttccgtcgagcctcactggatcgccgcatctattatcctggaatttttcctcatggtgctgcttatacccgagccagacagacagcgcacacctcaggataatcaactcgcttatgttgtgatcggtctgttgtttatgattctgacggtcgccgcaaacgagatgggcttactagaaaccactaagaaagacctggggatcggacatgtagccgctgagaaccaccagcacgcgacaatgctcgatgtggaccttcatcccgccagcgcatggaccctgtacgctgttgccaccacagtgattactccaatgatgaggcacacgatcgaaaataccacagccaacatatccttgactgcaattgctaatcaggccgcgatcctgatgggcctcgataagggttggcctatttcaaagatggacctgggggtcccgcttttagctctgggctgctactctcaagtgaaccccctcaccttgacagccgcagtcctgatgctagtggcccattatgctatcataggaccaggcctgcaggcaaaagccacccgggaggcgcagaagcgtactgctgccgggatcatgaaaaatcctacggttgatggaattgtggcaatcgacctcgatcccgtagtgtacgacgccaagttcgaaaaacagcttggccaaattatgctgttgatcctgtgtacaagtcagatactcctgatgagaaccacttgggctttatgcgagtcgattacccttgccacaggtccactgactaccctctgggaggggagccctggaaagttttggaacacaacgatcgcagtctccatggctaatatcttcaggggctcttatctagccggtgcgggcctggccttctcattgatgaaaagcctagggggaggccgccgggggaccggagcacagggcgaaactctcggtgagaaatggaagcgacagcttaaccaactgtccaaaagtgaatttaatacatacaagagatctgggattatggaggttgacaggagcgaagctaaagagggattgaagcgcggcgagaccactaagcacgccgtgtcacggggtacagcaaaactgagatggttcgtcgaacgtaacctcgtgaagcccgagggcaaagtaatcgatttagggtgtggaaggggcgggtggtcctattactgcgctggactgaagaaagtgaccgaagttaagggctatacgaaaggtgggccgggacatgaggaaccaatacctatggccacctacggctggaatcttgtgaagctgcacagtggcaaggacgtctttttcatgcccccagagaaatgtgatacactactctgcgacattggggagagctctcccaaccctactatcgaagagggacggaccctgcgcgtgttgaagatggtcgaaccgtggctgcgaggtaatcagttttgtattaaaatcctcaacccctacatgccatccgtggttgagacacttgagcagatgcagagaaagcacggcgggatgctggtaaggaatcctttatcacggaacagcactcatgaaatgtattgggtgtcgtgcggaaccggcaatatagtctctgccgtgaacatgacaagtcgcatgctgttgaacagattcaccatggcgcacaggaaacccacttacgagcgagatgttgacctcggtgctgggacgcggcatgtggcagtcgaacctgaggtggccaatctggatatcattggacaacgtatcgaaaacattaagaatgagcacaagtccacatggcactatgacgaggataacccatacaaaacctgggcttatcatggcagctacgaagtaaagccctcaggctccgcctctagcatggtgaatggggttgtcagactacttactaaaccttgggacgtgatcccaatggtgacccagattgcaatgacagatacgaccccctttggacagcaacgcgtcttcaaggagaaagttgacactaggacaccgcgggccaagagaggtaccgctcagatcatggaagtgactgcgaagtggctgtggggctttctcagtcgcaacaaaaagcctaggatatgtacacgagaggagttcacccggaaagtaagatccaatgccgcaattggggctgtgtttgtcgacgagaaccagtggaatagcgccaaggaggcagtggaagatgagaggttctgggacctggttcaccgcgaacgtgagttgcataaacagggaaagtgcgccacatgcgtgtataacatgatgggcaagcgggagaagaagctgggtgagtttgggaaagctaagggatctagagccatctggtacatgtggctcggcgcgaggttccttgagttcgaagcactgggctttatgaatgaggatcactggttctcacgcgaaaacagtttatccggggtcgagggagagggtctgcataaattgggctacatcctccgagacattagcaagataccagggggaaatatgtatgccgatgacactgctggctgggatacccggatcacggaagacgatctgcaaaacgaggccaaaattaccgacatcatggaacccgagcacgcactacttgctacatctatttttaagctgacttaccagaataaggtggtaagagttcagaggcctgccaaaaacggtaccgtgatggatgtcatctcgcgcagagaccagcgggggtcaggacaagtgggcacatatggcctcaacactttcaccaatatggaagtgcagctgataaggcagatggagagcgaggggatctttttcccatccgaattggagagtcccaacttagctgaacgtgtcctggattggctcgagaagcacggagccgaacgacttaaacgcatggcaatttctggtgacgactgtgttgtgaagccgatcgatgacagatttgcgacggccctgattgctctaaatgatatgggcaaagtacggaaggacatccctcagtgggagcccagcaaggggtggaacgattggcaacaggtgccattctgctcccatcactttcatcagctgataatgaaagacggaagggagattgtcgtgccttgtcgcaatcaggatgaactcgttggcagagcccgggtgtcacaaggtgcagggtggagtttgagggagacagcttgcctgggaaagtcttacgcccagatgtggcagcttatgtatttccaccgacgtgacctgagactcgcagccaacgcgatctgtagcgctgtccccgtggattgggtaccaacctcccgcactacatggtcaatccacgcccatcaccaatggatgaccactgaagacatgttaagcgtttggaatcgggtgtggattgaggaaaacccctggatggaggataaaacccatgtctcttcctgggaggaagtgccttacctgggcaagagggaggaccagtggtgcggcagtttgatagggctgacagcaagagccacgtgggctaccaatatccaggttgccattaaccaggtgcgccggctcatcggaaatgaaaactatcttgactacatgactagcatgaaaaggtttaagaatgagtcggatccagagggtgcactgtggtga

SEQ ID NO: 13202 - RNA, 9879 nt, synthetic construct
  misc_feature 1..9879: note = derived and/or modified CDS sequence (opt3) from DENV-1__JX669473__SS-prME
  source 1..9879: mol_type = other RNA
agcgtgaccatgctgctcatgcttctgcccaccgcattggctttccacttaactacgagaggaggggaacctcatatgatcgtctccaagcaggaaaggggaaaatctctgctgtttaagacctcagccggtgttaatatgtgcacactcattgcaatggacctgggagaactttgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggattgggtctcgagactagaaccgaaacatggatgtcctctgagggggcctggaaacagatccagaaggtggaaacttgggctctgaggcaccctggattcaccgttattgcactgtttctcgcccatgctatcggcacatcgattacccagaagggcatcatattcatcttactgatgcttgtgacgccatcaatggccatgcggtgcgtcgggattggaaatcgcgattttgtggagggtttgagcggcgcgacttgggtagacgttgtgctggagcacgggagttgtgtcacaaccatggccaagaataagcccactctagatatcgaactcctgaaaacagaggtgaccaaccctgccgtgcttagaaagctgtgcattgaagctaaaatctccaatacgaccacagactctaggtgtccaactcaaggagaggccaccttggtcgaagaacaagatgcaaacttcgtttgccggcgcacatttgtggaccgaggctggggtaatgggtgtggactcttcggcaagggcagcctgttaacttgcgctaagtttaaatgcgtaaccaagctggaggggaaaatagtgcagtacgaaaacctcaagtattccgtcattgtgacagttcacaccggagatcagcatcaagtgggtaatgagactacggaacacggcacaatcgccaccattactccccaggcgccttcaagtgagatccagcttaccgactacggggccctgacattggactgtagcccaagaaccggactagatttcaacgaaatggtcctgctcactatgaaagagaagtcttggctggtgcataaacagtggtttcttgacctgccgttgccctggacatccggcgcatcaacgagccaagagacctggaataggcaggatctcctggtaactttcaagacagctcacgccaagaaacaggaagttgtggtcttaggtagtcaagagggggctatgcacaccgccctgacaggcgcaactgaaatccagacctctggaacgaccacaatttttgccggccatctaaagtgccggctcaaaatggacaagctgactcttaaagggacctcctatgtgatgtgtacaggcagcttcaagttggagaaggaagtcgctgagactcagcacggtaccgtgctggttcaggtgaaatacgagggcacggatgcgccttgcaagataccattctcgacacaagacgaaaaaggggtaacccagaacggacgtctcatcactgcaaatcccattgtcacagataaggagaaacctgtgaacatcgaaaccgagccaccctttggcgagtcttatatagttgtgggtgccggggaaaaggctctgaaactttcctggttcaaaaagggctcaagtattggaaaaatgtttgaggccactgcacgcggcgccagaaggatggctatcctgggggacaccgcctgggatttcggaagcatcggtggcgtctttacatccgtggggaagttggtacatcaggtgttcggaacggcatacggcgttctcttttctggtgtcagctggaccatgaaaattgggatcggcattctgttaacttggctgggactaaattcacggagtacatccctcagcatgacctgtatagcggtgggcatggtgacactgtaccttggggtcatggttcaggctgactctggatgcgtgatcaactggaagggccgagaattgaagtgtggttcagggattttcgtgactaacgaggtacacacctggacggaacaatataaatttcaggccgatagtccgaagcgcctgagcgcagccatcggcagagcttgggaggagggcgtctgcggtatcaggtccgccacacggctcgaaaatattatgtggaaacagatatctaacgagctgaatcatatcttactggaaaacgacatgaagttcaccgtggttgtgggcaatgcaaacgggattcttgctcagggcaagaaaatgatcaaacctcaacccatggagcacaagtactcgtggaaaagctggggcaaggccaagattatcggggcggacatacagaatgccacttttatcattgatggaccagacacccctgaatgtcccgatgagcagcgcgcttggaacatctgggaggtcgaagactatggcttcggtatttttacaactaatatctggttgaaactcagagattcctacacccagatgtgcgaccacaggctgatgtcagcagccataaaggatagtaaagctgtgcatgccgacatggggtattggattgagtctgaaaagaacgagacatggaagctagcacgtgcgagcttcatcgaagttaaaacgtgtatttggccaaagtcccacaccctgtggtcaaatggagtgctcgagagcgagatgatcatacccaaaatgtacggcggtcctatctctcaacataactatcggccaggctacttcactcagacagccgggccgtggcacctgggaaaacttgaattggattttgacctgtgcgagggcaccactgtagtcgtggatgaacactgcgggtcccgaggacccagtttaagaacaaccacggtgactggcaaaattatccatgagtggtgttgcaggagctgtaccctccctccactgcgcttccggggtgaggacgggtgctggtacggaatggaaattagacccgtcaaggagaaggaagagaatcttgttaggtctatggtgtccgctggctcaggtgaagtagatagttttagcctgggcatcttgtgtgtgtcgataatgattgaggaggtcatgcgctcccgatggtctcggaaaatgctcatgacagggaccctggccgtgttcctactgctcatcatgggacagctgacttggaacgaccttatccgtttgtgcattatggttggcgcaaatgctagcgacaagatggggatgggaacaacctatctggccttaatggcaacatttaaaatgagacctatgttcgccgtgggcctcctgtttaggcgccttacttcacgggaagtcctgctactcaccatcggtctgagtttggtggcttccgttgagctgccaaactctttagaagaactcggggatggactggcgatgggcattatgatgcttaagctgttgacggagttccaaccccaccagctctggacaaccctgctaagcctgacttttataaaaaccacactttccctcgactacgcctggaagactaccgcaacggtgctgtcaatcgtcagcttgttcccgctgtgtttaagtacaacctctcagaagactacatggctccctgtactgcttggctcctttgggtgcaaaccactgaccatgttcttgattactgagaacaagatctggggaagaaaaagctggcccctcaatgagggtattatggctatcggcatagtgtcgatcctgctatcatctctgcttaagaacgatgttcctctcgccgggcccctgattgccggaggcatgttgatcgcttgttatgtgattagtggttccagcgcagacttatctctggaaaaagccgcggaggtcagctgggaagaggaagctgagcattccgggacatcacacaatatcctcgtggaggtacaggatgacggaaccatgaagataaaagatgaagagagggacgatacgctgactattcttctgaaggccaccttgctagcagtgagtggcgtctacccaatgagcatccctgccacactgtttgtttggtatttctggcaaaagaaaaagcagcgatctggcgtgctctgggacaccccctccccaccggaagtggagcgcgctgtcctggatgacgggatctaccggattcttcagagaggattactgggtaggtcacaggtgggcgttggggtattccaagatggagtgtttcatacaatgtggcacgtcactcgtggcgcagtgctcatgtatcagggtaaacgcttggagcctagttgggccagcgttaagaaagacctgatatcctacgggggaggctggcggttccagggctcttggaacaccggggaagaggtgcaggtcatcgcggtggaacccggaaagaatccaaagaacgtacaaacgacacccggtacttttaaaacccctgagggcgaagtcggggctattgccctcgacttcaagccaggaacatcgggcagccccatcgtgaatagagagggtaaaattgttgggctgtacggaaacggcgtggtcaccacttcaggcacctatgtgtccgcaatcgcccaggctaaggccagtcaggaggggcctcttccggaaatagaggatgaagtttttaaaaagaggaatctgacaatcatggacttgcacccaggatctggtaagacgcgacggtacctacccgcaattgtgcgcgaggctatcaaaagaaagctgaggactctcattttagcccctacccgggtcgtggcgagcgaaatggccgaggcactgaaaggcatgccaatccgatatcaaacaaccgctgtaaagtccgagcatactgggagagaaatagtggatcttatgtgccacgccacattcaccatgcgcctgctctcacccgttagggtccctaactacaatatgattatcatggacgaggctcattttacggatccggcatctatcgccgcccgtggatatattagcactcgggtgggcatgggtgaagctgcggcaatcttcatgacagccacacccccagggagtgtggaggcttttcctcagtccaacgccgtcatacaggacgaagagagagatattcccgagaggagctggaactctggatacgactggatcaccgatttcccaggcaaaactgtatggtttgtgccttcaattaagtccggcaacgacatcgcaaattgtttgcgcaagaacgggaaacgagttatacagctgagtagaaagacattcgataccgaatatcagaagacaaagaacaatgactgggactacgtggtcactacggatattagcgagatgggagccaacttccgggctgacagggtgatcgatccccgccgttgcctcaaaccagttatcctgaaggacggtccggaaagagtgattcttgcgggccctatgcccgtcaccgtggcctcggcagctcagcggagggggcgcatcggacgaaatcagaacaaggagggcgatcagtacgtatatatgggtcaaccactaaataacgacgaggatcacgcccattggacagaagcaaaaatgctgttggacaatattaacactcccgaggggataatccctgccttatttgaaccagagagagaaaagtctgctgccattgatggcgagtaccggctgaggggagaggcgcgcaaaaccttcgtggaactcatgagaaggggcgacctgcccgtttggctttcctataaggtcgcaagcgaggggtttcagtactcagatcggcgttggtgcttcgacggagaacgcaataaccaggtgctggaggaaaatatggatgtggagatctggacaaaagagggtgaacgaaagaaactcagacctaggtggttggacgcccggacctatagtgacccgctggctctacgcgagtttaaggagttcgccgctggcagaaggtctgtctccggggatctgatcctcgagattggaaaacttccacagcacctgactttacgggcacaaaacgccttggacaatctggttatgctccacaacagcgaacagggcggtaaggcttaccgacatgccatggaggagctgcccgatacgatagaaacccttatgctgctcgcattgatcgcggtgctgacagggggcgtaactttatttttcctatcaggaaagggcctggggaaaaccagtattggactcctttgtgtgacagccagctccgctctgttgtggatggcctctgtcgagcctcactggatcgcagctagcattatcctggaatttttcctcatggtgctgcttatacccgagccagacagacagcgcacccctcaggataatcaactcgcctatgttgtgatcggtctgttgtttatgattctgactgtcgcagccaacgagatgggcttactagaaacaacgaagaaagacctggggatcggacatgtagctgcggagaaccaccagcacgccaccatgctcgatgtggaccttcatcccgcatccgcttggactctgtacgccgttgccacaaccgtgattaccccaatgatgaggcacacaatcgaaaatactacggcaaacatatcattgaccgctattgccaatcaggcggctatcctgatgggcctcgataagggttggcctatttctaagatggacctgggggtcccgcttttagccctgggctgctacagtcaagtgaaccccctcacattgactgcagccgtcctgatgctagtggctcattatgcaatcataggaccaggcctgcaggccaaagcgacccgggaggctcagaagcgtacagccgcagggatcatgaaaaatcctaccgttgatggaattgtggccatcgacctcgatcccgtagtgtacgacgctaagttcgaaaaacagcttggccaaattatgctgttgatcctgtgtacttcgcagatactcctgatgagaacgacatgggccttatgcgagagcattacccttgcaactggtccactgaccacactctgggaggggtcccctggaaagttttggaacactaccatcgctgtctctatggccaatatcttcaggggctcatatctagcgggtgccggcctggcattcagcttgatgaagtccctagggggaggccgccgggggacaggagctcagggcgaaacgctcggtgagaaatggaagcgacagcttaaccaactgagtaaatctgaatttaatacctacaagagaagcgggattatggaggttgacaggtcagaagccaaagagggattgaagcgcggcgagactacaaagcacgcagtgtcccggggtaccgctaaactgagatggttcgtcgaacgtaacctcgtgaagcccgagggcaaagtaatcgatttagggtgtggaaggggcgggtggagttattactgcgccggactgaagaaagtgactgaagttaagggctatacaaaaggtgggccgggacatgaggaaccaatacctatggccacctacggctggaatcttgtgaagctgcacagcggcaaggacgtctttttcatgcccccagagaaatgtgatacgctactctgcgacattggggagtcttcccccaaccctaccatcgaagagggacggacactgcgcgtgttgaagatggtcgaaccgtggctgcgaggtaatcagttttgtattaaaatcctcaacccctacatgccatcagtggttgagactcttgagcagatgcagagaaagcacggcgggatgctggtaaggaatcctttaagccggaactcgacccatgaaatgtattgggtgtcttgcggaacaggcaatatagtcagtgcggtgaacatgacttcccgcatgctgttgaacagattcaccatggctcacaggaaacccacatacgagcgagatgttgacctcggtgcagggacccggcatgtggccgtcgaacctgaggtggctaatctggatatcattggacaacgtatcgaaaacattaagaatgagcacaagagcacttggcactatgacgaggataacccatacaaaacgtgggcctatcatggctcatacgaagtaaagccctccggctctgcaagcagtatggtgaatggggttgtcagactacttacaaaaccttgggacgtgatcccaatggtgacccagattgccatgactgataccacaccctttggacagcaacgcgtcttcaaggagaaagttgacacgaggaccccgcgggctaagagaggtactgcgcagatcatggaagtgacagccaagtggctgtggggctttctctcccgcaacaaaaagcctaggatatgtacccgagaggagttcactcggaaagtaagaagcaatgcagctattggggccgtgtttgtcgacgagaaccagtggaactctgcaaaggaggccgtggaagatgagaggttctgggacctggttcaccgcgaacgtgagttgcataaacagggaaagtgcgctacatgcgtgtataacatgatgggcaagcgggagaaaaagctgggtgagtttgggaaagccaagggatcaagagcgatctggtacatgtggctcggcgcaaggttccttgagttcgaagccctgggctttatgaatgaggatcactggttcagtcgcgaaaactccttaagcggggtcgagggagagggtctgcataaattgggctacatcctccgagacatttctaagataccagggggaaatatgtatgctgatgacaccgccggctgggatacacggatcactgaagacgatctgcaaaacgaggcaaaaattaccgacatcatggaacccgagcacgctctacttgccacgtcgatttttaagctgacctaccagaataaggtggtaagagttcagaggcctgctaaaaacggtacagtgatggatgtcatctcacgcagagaccagcgggggagcggacaagtgggcacttatggcctcaacaccttcacaaatatggaagtgcagctgataaggcagatggagtccgaggggatctttttcccaagtgaattggagtctcccaacttagccgaacgtgtcctggattggctcgagaagcacggagcagaacgacttaaacgcatggcgattagcggtgacgactgtgttgtgaagccgatcgatgacagatttgccactgctctgattgccctaaatgatatgggcaaagtacggaaggacatccctcagtgggagccctccaaggggtggaacgattggcaacaggtgccattctgctcacatcactttcatcagctgataatgaaagacggaagggagattgtcgtgccttgtcgcaatcaggatgaactcgttggcagagcacgggtgagtcaaggtgctgggtggtctttgagggagaccgcctgcctgggaaagagctacgcacagatgtggcagcttatgtatttccaccgacgtgacctgagactcgccgcgaacgctatctgttccgccgtccccgtggattgggtaccaacgtcacgcacaacctggagcatccacgcacatcaccaatggatgactacagaagacatgttatctgtttggaatcgggtgtggattgaggaaaacccctggatggaggataaaacccatgtctccagttgggaggaagtgccttacctgggcaagagggaggaccagtggtgcggcagcttgatagggctgactgccagagctacctgggccacaaatatccaggttgcaattaaccaggtgcgccggctcatcggaaatgaaaactatcttgactacatgacgtcgatgaaaaggtttaagaatgagtccgatccagagggtgctctgtggtga

SEQ ID NO: 13203 - RNA, 9879 nt, synthetic construct
  misc_feature 1..9879: note = derived and/or modified CDS sequence (opt3) from DENV-1__JX669474__SS-prME
  source 1..9879: mol_type = other RNA
agcgtgaccatgctgctcatgcttctgcccactgcattggctttccacttaactacgagaggaggggagcctcatatgatcgtctccaagcaggaaaggggaaaatctctgctgtttaagacctcagccggtgttaacatgtgcacactcattgcaatggacctgggagagctttgtgaagatactatgacctacaaatgcccacggataaccgaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaaacagatccagaaggtggaaacttgggctctgaggcaccctggattcaccgttattgcactgtttctcgcccatgctatcggcacatcgattacccagaagggcatcatattcatcttactgatgcttgtgacgccatcaatggccatgcggtgcgtcgggattggaaaccgcgattttgtggagggtttgagcggcgcgacttgggtagacgttgtgctggagcacgggagttgtgtcacaaccatggccaagaataagcccactctagatatcgaactcctgaaaacagaggtgaccaaccctgccgtgcttagaaagctgtgcattgaagctaaaatctccaatacgaccacagactctaggtgtccaactcaaggagaggccaccttggtcgaagaacaggatgcaaacttcgtttgccggcgcacatttgtggaccgaggctggggtaatgggtgtggactcttcggcaagggcagcctgttaacttgcgctaagtttaaatgcgtaaccaagctggaggggaaaatagtgcagtacgaaaacctcaagtattccgtcattgtgacagttcacaccggagatcagcatcaagtgggtaatgagactacggaacacggcacaatcgccaccattactccccaggcgcctacctcagagatccagcttacagactacggggccctgaccttggactgtagtccaagaactggactagatttcaacgaaatggtcctgctcacaatgaaagaaaagagctggctggtgcataaacagtggtttcttgacctgccgttgccctggacgtctggcgcatccacctcacaagagacttggaataggcaggatctcctggtaacattcaagaccgctcacgccaagaaacaggaagttgtggtcttaggtagccaagagggggctatgcacacagccctgactggcgcaaccgaaatccagacgagtggaaccacaactatttttgccggccatctaaagtgccggctcaaaatggacaagctgacccttaaagggatgtcttatgtgatgtgtacaggatccttcaagttggagaaggaagtcgctgagactcagcacggtaccgtgctggttcaggtgaaatacgagggcacggatgcgccttgcaagataccattcagcacacaagacgaaaaaggggtaacccagaacggacgtctcatcactgcaaatcccattgtcacagataaggagaaacctgtgaacatcgaaaccgagccaccctttggcgagtcgtatatagttgtgggtgccggggaaaaggctctgaaactttcttggttcaaaaagggctcctcaattggaaaaatgtttgaggccactgcacgcggcgccagaaggatggctatcctgggggacaccgcctgggatttcggaagtatcggtggcgtctttacaagcgtggggaagttggtacatcaggtgttcggaacggcatacggcgttctcttttccggtgtctcttggaccatgaaaattgggatcggcattctgttaacttggctgggactaaatagccggtcaacaagtctctccatgacctgtatagcggtgggcatggtgacactgtaccttggggtcatggttcaggctgacagcggatgcgtgatcaactggaagggccgagaattgaagtgtggttctgggattttcgtgactaacgaggtacacacctggacggaacaatataaatttcaggccgattcaccgaagcgcctgagtgcagccatcggacgagcttgggaggagggcgtctgcggtatcaggagcgccacacggctcgaaaatattatgtggaaacagatatccaacgagctgaatcatatcttactggaaaacgacatgaagttcaccgtggttgtgggcaatgcaaacgggattcttgctcagggcaagaagatgatcaaacctcaacccatggagcacaagtactcttggaagtcgtggggcaaagccaagattatcggggcggacatacagaatgccacttttatcattgatggaccagacacccctgaatgtcccgatgagcagcgcgcttggaacatctgggaggtcgaagactatggcttcggtatttttacaactaatatctggttgaaactcagagatagctacacccagatgtgcgaccacaggctgatgtccgcagccataaaggattcaaaagctgtgcatgccgacatggggtattggattgagagtgaaaagaacgagacatggaagctagcacgtgcgtctttcatcgaagttaaaacgtgtatttggccaaagagccacaccctgtggtccaatggagtgctcgagtcagagatgatcatacccaaaatgtacggcggtcctactagccaacataactatcggccaggctacttcacacagaccgccgggccgtggcacctgggaaaacttgaattggattttgacctgtgcgagggcactacagtagtcgtggatgaacactgcgggtctcgaggaccctccttaagaaccacgactgtgaccggcaaaatcattcatgagtggtgttgcaggagttgtacactccctccactgcgcttccggggtgaggacgggtgctggtacggaatggaaatcagacccgtcaaggagaaggaagagaatcttgttaggagcatggtgtctgctggctccggtgaagtagattcatttagtctgggcattttgtgtgtgagcatcatgatagaggaggtcatgcgctcgcgatggtcccggaaaatgctcatgaccgggactctggccgtgttcctactgctcattatgggacagctgacatggaacgaccttatccgtttgtgcatcatggttggcgcaaatgcttctgacaagatggggatgggaaccacatatctggccttaatggcaacttttaaaatgagacctatgttcgccgtgggcctcctgtttaggcgccttaccagccgggaagtcctgctactcacgattggtctgtcattggtggctagtgttgagctgccaaactccttagaagaactcggggatggactggcgatgggcatcatgatgcttaagctgttgacagagttccaaccccaccagctctggaccactctgctatctctgacctttattaaaacaactcttagcctcgactacgcctggaagaccacggcaacagtgctgtccatagtctcattgttcccgctgtgtttaagcaccacaagtcagaagacaacctggctccctgtactgcttggctcttttgggtgcaaaccactgactatgttcttgatcacagagaacgagatttggggaagaaagtcctggcccctcaatgaaggtatcatggctattggcatcgtgagcatactgctatcgtcactgcttaaaaacgatgttcctctcgccgggcccctgatcgccggaggcatgttgattgcttgttatgtgatctctggtagttccgcagacttaagcctggagaaggccgcggaagtctcttgggaggaagaggctgagcatagcgggacctcccacaatattctcgtggaagtacaggatgacggaacgatgaaaatcaaggatgaggaaagggacgatactctgaccatacttctgaaagccacattgctagcaatttcaggcgtgtacccaatgagtatccctgccaccctgtttgtctggtatttctggcaaaagaagaaacagcgaagcggcgttctctgggacacaccctctccaccggaggtggagcgcgctgtgctggatgacgggatctaccggattcttcagagaggattactgggtaggtcccaggtcggcgtgggggttttccaagatggagtatttcatactatgtggcacgtgacccgtggcgcagtcctcatgtatcagggtaagcgcttggaaccttcatgggccagtgtgaaaaaggacctgataagctacgggggaggctggcggttccagggctcctggaacacgggggaggaagttcaggtgatcgcggtcgagcccggcaagaatccaaagaacgtgcaaacaactcccggtacctttaagacacctgaaggcgaggtaggggctattgccctcgacttcaaaccaggaacctctggctcgcccatcgtcaatagagagggtaagattgtggggctgtacggaaacggcgttgtgactaccagcggcacatatgtctcagcaatcgcccaggctaaagcctcccaggaagggcctcttccggagatagaagatgaggtgtttaagaaaaggaatctgacgatcatggacttgcacccaggaagtggtaagactcgacggtacctacccgcaattgttcgcgaagctatcaagagaaaactgaggaccctcattttagcccctacacgggtggtcgcgtctgagatggccgaggcactgaagggcatgccaatccgatatcaaaccactgctgtgaaaagcgaacatacagggagagagatagtagatcttatgtgccacgccaccttcacgatgcgcctgctctcccccgtgagggttcctaactacaatatgattatcatggacgaagctcattttactgatccggcatcaatcgccgcccgtggatatatttctacacgggtcggcatgggtgaggctgcggcaatcttcatgaccgccacacccccagggagcgtggaggcttttcctcagagtaacgccgtgatacaggacgaggagagagatattcccgaaaggtcctggaatagcggatacgactggatcactgatttcccaggcaagacagtctggtttgtaccttctattaaatcaggcaacgacatcgcaaattgtttgcgcaagaacgggaagcgagtgatacagctgtccagaaaaaccttcgatacagagtatcaaaagactaaaaacaatgactgggactacgttgtgacgaccgatattagtgaaatgggagccaacttccgggctgacagggtcatcgatccccgccgttgcctcaagccagtgatcctgaaagacggtccggagagagttattcttgcgggccctatgcccgtgacagtcgccagcgcagctcagcggagggggcgcatcggacgaaatcagaacaaggagggcgatcagtacgtgtatatgggtcaaccactaaataacgacgaagatcacgcccattggactgaggcaaagatgctgttggacaatattaacacccccgaagggataatccctgccttatttgagccagaaagagagaaatcggctgccattgatggcgagtaccggctgaggggagaagcgcgcaagacattcgtagagctcatgagaaggggcgacctgcccgtgtggctttcttataaagttgcatccgaagggtttcagtacagcgatcggcgttggtgcttcgacggagagcgcaataaccaggtcctggaagagaatatggatgtggagatctggaccaaggaaggtgagagaaagaagctcagacctaggtggttggacgcccggacttattcagacccgctggctctacgcgaatttaaagagttcgccgctggcagaaggagtgtgtctggggatctgatcctcgaaattggaaaacttccacagcacctgacgttacgggcacaaaacgccttggacaatctggtcatgctccacaactccgagcagggcggtaaggcttaccgacatgccatggaggaactgcccgataccatagagacacttatgctgctcgcattgatcgcggttctgactgggggcgtgaccttatttttcctaagcggaaaaggcctggggaagacatcaattggactcctttgtgtaaccgccagtagcgctctgttgtggatggcctccgtggaacctcactggatcgcagcttctattatcctggagtttttcctcatggtcctgcttatacccgagccagacagacagcgcactcctcaggataatcaactcgcctatgtggttatcggtctgttgtttatgattctgacagtggcagccaacgaaatgggcttactagagacgaccaaaaaggacctggggatcggacatgtcgctgcggaaaaccaccagcacgccactatgctcgatgtagaccttcatcccgcaagcgcttggacactgtacgccgtggccaccaccgttattacaccaatgatgaggcacactatcgagaatacgaccgcaaacatatccttgacagctattgccaatcaggcggctatcctgatgggcctcgataaaggttggcctatttcaaagatggacctgggggtgccgcttttagccctgggctgctactctcaagtcaaccccctcactttgaccgcagccgtgctgatgctagtcgctcattatgcaatcataggaccaggcctgcaggccaaggcgacacgggaagctcagaaacgtaccgccgcagggatcatgaagaatcctactgtggatggaattgttgccatcgacctcgatcccgtggtatacgacgctaaattcgagaagcagcttggccaaattatgctgttgatcctgtgtacgagtcagatactcctgatgagaacaacctgggccttatgcgagtcgattactcttgcaaccggtccactgacaactctctgggaagggagccctggaaaattttggaacaccacaatcgctgtgtccatggccaatatcttcaggggctcttatctagcgggtgccggcctggcattctcattgatgaaaagcctagggggaggccgccgggggacgggagctcagggcgagaccctcggtgaaaagtggaaacgacagcttaaccaactgtccaagagtgagtttaatacttacaaaagatctgggattatggaagtcgacaggagcgaggccaaggagggattgaaacgcggcgaaacaaccaagcacgcagtttcacggggtactgctaagctgagatggttcgtggagcgtaacctcgtcaaacccgaaggcaaggtgatcgatttagggtgtggaaggggcgggtggtcctattactgcgccggactgaaaaaggtaacagaggtgaaaggctataccaagggtgggccgggacatgaggaaccaatacctatggccacgtacggctggaatcttgttaaactgcacagtggcaaggacgtgtttttcatgcccccagagaagtgtgataccctactctgcgacattggggaaagctctcccaaccctacaatcgaggaaggacggactctgcgcgtcttgaaaatggtggagccgtggctgcgaggtaatcagttttgtattaagatcctcaacccctacatgccatccgtcgtggagacccttgaacagatgcagagaaaacacggcgggatgctggttaggaatcctttatcacggaacagcacacatgagatgtattgggtatcgtgcggaactggcaatatagtgtctgcggtcaacatgaccagtcgcatgctgttgaacagattcacaatggctcacaggaagcccacctacgaacgagatgtggacctcggtgcagggactcggcatgttgccgtggagcctgaagtcgctaatctggatatcattggacaacgtatcgagaacattaaaaatgagcacaagtccacgtggcactatgacgaagataacccatacaagacatgggcctatcatggcagctacgaggtgaaaccctcaggctccgcatctagcatggtaaatggggtggttagactacttaccaagccttgggacgtcatcccaatggtgactcagattgccatgaccgatacaacgccctttggacagcaacgcgtgttcaaagaaaaggtcgacaccaggactccgcgggctaaaagaggtacagcgcagatcatggaggttaccgccaagtggctgtggggctttctcagtcgcaacaagaaacctaggatatgtactcgagaagagttcacacggaaggtgagatccaatgcagctattggggccgtatttgtggacgagaaccagtggaatagcgcaaaagaagccgtcgaggatgaaaggttctgggacctggtgcaccgcgagcgtgaattgcataagcagggaaaatgcgctacctgcgtttataacatgatgggcaagcgggagaagaaactgggtgagtttgggaaggccaaaggatctagagcgatctggtacatgtggctcggcgcaaggttccttgagttcgaggccctgggctttatgaatgaagatcactggttctcacgcgagaacagtttatccggggtggagggagaaggtctgcataagttgggctacatcctccgagacattagcaaaataccagggggaaatatgtatgctgatgacacagccggctgggatactcggatcaccgaggacgatctgcaaaacgaagcaaagattacggacatcatggagcccgaacacgctctacttgccacctctatttttaaactgacataccagaataaggtcgtgagagtacagaggcctgctaagaacggtactgttatggatgtgatctcgcgcagagaccagcgggggtcaggacaagtcggcacctatggcctcaacacattcactaatatggaggtgcagctgataaggcagatggagagcgaagggatctttttcccatccgagttggaaagtcccaacttagccgagcgtgtgctggattggctcgaaaaacacggagcagagcgacttaagcgcatggcgatttctggtgacgactgtgtcgttaaaccgatcgatgacagatttgccaccgctctgattgccctaaatgatatgggcaaggtgcggaaagacatccctcagtgggagcccagcaaggggtggaacgattggcaacaggtaccattctgctcccatcactttcatcagctgataatgaaggacggaagggaaattgtggtcccttgtcgcaatcaggatgagctcgtgggcagagcacgggtttcacaaggtgctgggtggagtttgagggaaacggcctgcctgggaaaatcttacgcacagatgtggcagcttatgtatttccaccgacgtgacctgagactcgccgcgaacgctatctgtagcgccgtgcccgtcgattgggtgccaacatcccgcaccacttggtcaatccacgcacatcaccaatggatgacaaccgaggacatgttaagcgtatggaatcgggtttggattgaagagaacccctggatggaggataagactcatgtgtcttcctgggaagaggtcccttacctgggcaaaagggaagaccagtggtgcggcagtttgatagggctgaccgccagagctacatgggccacgaatatccaggtggcaattaaccaggttcgccggctcatcggaaatgagaactatcttgactacatgaccagcatgaagaggtttaaaaatgagtcggatccagaaggtgctctgtggtga

SEQ ID NO: 13204 - RNA, 9879 nt, synthetic construct
  misc_feature 1..9879: note = derived and/or modified CDS sequence (opt3) from DENV-1__JX669475__SS-prME
  source 1..9879: mol_type = other RNA
agcgtgaccatgctgctcatgcttctgcccacagcattggctttccacttaactacgcgaggaggggagcctcatatgatcgtctccaagcaggaaaggggaaagtctctgttgtttaagacctcagccggtgttaatatgtgcaccctcattgcaatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaaacagatccagaaggtggaaacttgggctctgaggcaccctggattcaccgttattgcactgtttctcgcccatgctatcggcacatcgattacccagaagggcatcattttcatcttactgatgcttgtgacgccatcaatggccatgcggtgcgtcgggattggaaaccgcgattttgtggagggtttgagcggcgcgacttgggtagacgttgtgctggagcacgggagttgtgtcacaaccatggccaagaataagcccactctagatatcgaactcctgaaaacagaggtgaccaaccctgccgtgcttagaaagctgtgcattgaagctaaaatctccaatacgaccacagactctaggtgtccaactcaaggagaggccaccttggtcgaagaacaagatgcaaacttcgtttgccggcgcacatttgtggaccgaggctggggtaatgggtgtggactcttcggcaagggcagcctgttaacttgcgctaagtttaaatgcgtaaccaagctggaggggaaaatagtgcagtacgaaaacctcaagtattccgtcattgtgacagttcacaccggagatcagcatcaagtgggtaatgagactacggaacacggcacaatcgccaccattactccccaggcgcctacctcagagatccagcttacagactacggggccctgaccttggactgtagtccaagaactggactagatttcaacgaaatggtcctgctcacaatgaaagagaaaagctggctggtgcataaacagtggtttcttgacctgccgttgccctggacgtctggcgcatccacctcacaagaaacttggaataggcaggatctcctggtaacattcaagaccgctcacgccaagaaacaggaagttgtggtcttaggtagccaagagggggctatgcacacagccctgactggcgcaaccgaaatccagacgagtggaaccacaactatttttgccggccatctaaagtgccggctcaaaatggacaagctgacccttaaagggacatcttatgtgatgtgtactggatccttcaagttggagaaggaagtcgctgagacccagcacggtacggtgctggttcaggtgaaatacgagggcacagatgcgccttgcaagataccattcagcacccaagacgaaaaaggggtaactcagaacggacgtctcatcacagcaaatcccattgtcaccgataaggagaaacctgtgaacatcgaaactgagccaccctttggcgagtcgtatatagttgtgggtgccggggaaaaggctctgaaactttcttggttcaaaaagggctcctcaattggaaaaatgtttgaggccaccgcacgcggcgccagaaggatggctatcctgggggacacagcctgggatttcggaagtatcggtggcgtctttacgagcgtggggaagttggtacatcaggtgttcggaaccgcatacggcgttctcttttccggtgtctcttggactatgaaaattgggatcggcattctgttaacatggctgggactaaatagccggtcaaccagtctctccatgacatgtatagcggtgggcatggtgactctgtaccttggggtcatggttcaggctgacagcggatgcgtgatcaactggaagggccgagaattgaagtgtggttctgggattttcgtgaccaacgaggtacacacgtggacagaacaatataaatttcaggccgattcaccgaagcgcctgagtgcagccatcggaaaggcttgggaggagggcgtctgcggtatcagaagcgccaccaggctcgaaaatattatgtggaagcagatatccaacgagctgaatcatatcttactggaaaacgacattaaattcactgtggttgtgggcaatgcaaacgggatccttgctcagggaaagaaaatgattcggcctcaacccatggagcacaagtactcttggaagtcgtggggcaaagccaagatcataggggcggacatccagaataccacatttattatcgatggaccagacactcctgaatgtcccgatgagcagcgcgcctggaacatttgggaggtcgaagactatggcttcggtatctttaccacaaatatatggttgaaactcagagatagctacacgcagatgtgcgaccacaggctgatgtccgctgcaattaaggattcaaaagccgtgcatgctgacatggggtattggatcgagagtgaaaagaacgagacctggaagctagcccgtgcatctttcattgaagttaaaacttgtatctggccaaagagccacacactgtggtccaatggagtgctcgagtcagagatgataatccccaaaatgtacggcggtcctattagccaacataactatcggccaggctacttcacccagactgcggggccgtggcacctgggaaaacttgaattggattttgacctgtgcgagggcacaaccgtagtcgtggatgaacactgcgggtctcgaggaccctccttaagaacgactaccgtgacaggcaaaatcattcatgagtggtgttgcaggagttgtaccctccctccactgcgcttccggggtgaggacgggtgctggtacggaatggaaatcagacccgtcaaggagaaggaagagaatcttgttaggagcatggtgtctgccggctccggtgaagtagattcatttagtctgggcatattgtgtgtgagcattatgatcgaggaggtcatgcgctcgcgatggtcccggaaaatgctcatgactgggacactggctgtgttcctactgctcatcatgggacagctgacctggaacgaccttattcgtttgtgcatcatggttggcgccaatgcatctgacaagatggggatgggaacaacttatctggctttaatggccacctttaaaatgagacctatgttcgcagtgggcctcagctttaggcgcctgacgtcacgggaagtccttctgctaacaattggtctcagtctggtggcctccgttgagttgccaaactctctggaagagttaggggatggactcgctatgggcataatgatgctgaaacttctgaccgagttccaaccccaccagttgtggactaccctcctgagcctaacatttatcaaaactaccctgtcccttgactacgcgtggaagacgacagccatggtgctctcaattgtcagcctgttcccgttgtgtctgagtaccacttctcagaagacaacctggttacctgtactcctgggctcctttgggtgcaaaccacttactatgttcctgatcacagagaacgagatttggggaagaaagagctggcccttgaatgaaggtatcatggcaataggcatcgtgtcgattctcctgtcatctctactgaaaaacgatgttcctcttgctgggcccctcatcgccggaggcatgctgattgcctgttatgtgatcagtggttccagcgctgacttgtctttagagaaggcagccgaagtcagctgggaggaagaggcggagcattccgggacctcacacaatatactggtggaagtacaggatgacggaacgatgaaaattaaggatgaggaaagggacgatactctcaccatcctgcttaaagctacactgttggccgtgagtggcgtctacccaatgagcatccctgcaaccctatttgtttggtatttctggcaaaagaagaaacagcgatctggcgtgctgtgggacacaccctccccaccggaggtggagcgcgccgtcctcgatgacgggatttaccggatactgcagagaggacttttaggtaggtcacaggtgggcgttggggtattccaagatggagtgtttcatactatgtggcacgtcacccgtggcgctgtgctgatgtatcagggtaagcgcctcgaacctagttgggcaagcgttaaaaaggacttgatctcctacgggggaggctggcggttccagggctcttggaacacgggggaggaagtgcaggtcattgccgtggagcccggcaagaatccaaagaacgtacaaacaactcccggtacctttaagacacctgaaggcgaggtcggggcgatcgctctggacttcaaaccaggaacctcgggcagccccattgtgaatagagagggtaagatcgttgggctctacggaaacggcgtggtcactacctcaggcacatatgtgtccgccatagcacaggccaaagctagtcaggaagggcctctgccggagatcgaagatgaggtttttaggaagcgaaatcttacgattatggacctgcacccaggatctggtaaaactcggcgctacttgcccgccatcgtgagagaagcaattaagaggaagctacggaccctgatcctcgctcctacacgagtcgtggccagcgagatggcggaggccttaaaaggcatgccaataagatatcaaaccactgcagtaaagtccgaacatacagggcgcgagattgtggatctgatgtgccacgctaccttcacgatgaggcttctgtcacccgttcgtgtccctaactacaatatgatcatcatggacgaagcccattttactgatccggcttctattgcagcccggggatatatcagcacaagagtgggcatgggtgaggccgctgcgatattcatgaccgcaacacccccagggagtgtggaagcctttcctcagtccaacgctgtcattcaggacgaggagagggatatccccgaacgcagctggaactctggatacgactggattactgatttcccaggcaaaacagtatggtttgtgccttcaatcaagtccggcaacgacatagccaattgtctcagaaagaatgggaagagagttattcagttgagtcggaagaccttcgatacagagtatcagaagactaagaacaatgactgggactacgtggtcacgaccgatatcagcgaaatgggagcaaacttcagggccgaccgcgtgatcgatccccgtagatgcctgaaaccagttattctcaaggacggtccggagcgggtgatcctggctggccctatgcccgtcacagtggcgtcggccgcacagaggcgcgggcgaattggaagaaatcagaacaaagagggcgatcagtacgtatatatgggtcaaccacttaataacgacgaagatcacgctcattggactgaggccaagatgctactggacaatataaacacccccgaagggatcattcctgcattgtttgagccagaacgggagaagtctgccgctatcgatggcgagtacaggttacgcggagaagccagaaaaacattcgtggagctgatgaggcggggcgacctccccgtttggctgtcctataaggtcgcgagcgaagggtttcagtactcagatcgtcgctggtgcttcgacggagagcgaaataaccaggtgcttgaagagaatatggatgtggagatctggaccaaagaaggtgagagaaagaaactgaggcctcggtggctcgacgcacgcacttatagtgacccgttggccctgagagaatttaaggagttcgctgccggcaggcggtctgtctccggggatctaattctggaaataggaaaactcccacagcaccttacgctgcgagctcaaaacgcattagacaatttggttatgctgcacaacagcgagcagggcggtaaggcctacagacatgctatggaggaactccccgataccatcgagacactgatgcttctggccctcattgcagtgttgactgggggcgtaaccctgtttttcttatcaggaaagggcctagggaaaacaagtatcggactgctctgtgtgaccgcgagctccgcccttctgtggatggcttctgtcgaacctcactggattgccgcaagcatcatattggagtttttcctgatggtgctcctgatccccgagccagaccgccagaggactcctcaggataatcaacttgcttatgttgtgattggtctcctgtttatgatcttgacagtcgccgcaaacgaaatgggcctgttagagacgaccaagaaagacctagggattggacatgtagccgctgaaaaccaccagcacgcgactatgctggatgtggacctccatcccgcctccgcatggacactttacgctgttgccaccaccgtgatcacaccaatgatgcggcacactatagagaatacgaccgccaacatttcactgacagcaatcgctaatcaggccgcgattttgatgggcctggataagggttggcctatctctaaaatggacctcggggtcccgctgcttgctttaggctgctacagtcaagtgaaccccctgactctcaccgccgcagtcttgatgctggtggcccattatgctataatcggaccaggcctacaggcaaaggccacacgtgaagcgcagaagagaaccgctgccgggattatgaaaaatcctactgttgatggaatcgtggcaattgacctggatcccgtagtgtacgacgccaagttcgagaaacagctcggccaaatcatgcttctgatattgtgtacgtcgcagattctgctcatgaggacaacctgggctctgtgcgagagcatcactttagccaccggtccacttacaactctgtgggaagggtcccctggaaagttttggaacaccacaatcgcagtctctatggctaatattttccgcggctcatatctcgccggtgcgggcctagccttcagcctgatgaaatccctagggggaggccggcgagggacgggagcacagggcgagaccctgggtgaaaagtggaagagacagctcaaccaacttagtaaatctgagtttaatacttacaagaggagcgggatcatggaagttgaccgctcagaggctaaagagggactgaagcggggcgaaacaaccaaacacgccgtgtccagaggtactgcaaagttgcgttggttcgtcgagaggaacctggtgaagcccgaaggcaaagtaatagatctcgggtgtggacggggcgggtggagttattactgcgctggattaaagaaagtgacagaggttaagggctataccaaaggtgggccgggacatgaggaaccaattcctatggccacgtacggctggaatctggtgaaacttcacagcggcaaagacgtctttttcatgcccccagagaagtgtgataccctgctatgcgacatcggggaatcttcccccaaccctacaattgaggaaggacgcactctccgagtgctgaagatggtcgagccgtggttgagaggtaatcagttttgtatcaaaatactgaacccctacatgccatcagtggttgagaccctcgaacagatgcagaggaagcacggcgggatgcttgtacggaatcctctgagccgcaactcgacacatgagatgtattgggtgtcttgcggaactggcaatatcgtcagtgccgtgaacatgacctccagaatgttactgaacaggttcacaatggcgcaccgaaaacccacctacgaacgggatgttgacttgggtgctgggactcgtcatgtggcagtcgagcctgaagtggccaatctcgatattatcggacaaagaattgagaacatcaagaatgagcacaaaagcacgtggcactatgacgaagataacccatacaagacatgggcttatcatggctcatacgaggtaaagccctccggctctgccagcagtatggtgaatggggttgtccgcctgctaaccaaaccttgggacgtgattccaatggtgactcagatcgcaatgaccgatacaacgccctttggacagcaaagggtcttcaaggaaaaagttgacacccggactccgagagccaagcgcggtacagctcagataatggaggtgaccgcgaaatggctttggggctttctgtccaggaacaagaagcctcgaatttgtactcgggaagagttcacaagaaaagtaaggagcaatgccgcaatcggggctgtgtttgtcgacgagaaccagtggaactctgccaaggaagcagtggaggatgaacgcttctgggacctcgttcaccgtgagcgggaactgcataaacagggaaagtgcgctacctgcgtgtataacatgatgggcaaaagagagaagaagttgggtgagtttgggaaagccaagggatcaagggccatctggtacatgtggctgggcgcgcgcttcctcgagttcgaggcacttggctttatgaatgaagatcactggttcagtcgagagaactccctgagcggggtcgagggagaaggtttacataaactgggctacattttgcgggacatatctaagatcccagggggaaatatgtatgccgatgacacagctggctgggatactagaattaccgaggacgatctccaaaacgaagccaaaatcacggacattatggagcccgaacacgcactgctagctacctcgatctttaaacttacataccagaataaagtggtaagggttcagcgccctgccaagaacggtactgtgatggatgtcatatcaagacgggaccagagggggagcggacaagtgggcacctatggcctgaacacattcactaatatggaggtgcagctcatccgtcagatggagtccgaagggatatttttcccaagtgagctggaatctcccaacttggctgagcgagtcttagattggctggaaaagcacggagccgagcgcctcaaaagaatggcaatcagcggtgacgactgtgttgtgaagccgattgatgaccggtttgcgaccgcccttatcgctctgaatgatatgggcaaagtaaggaaggacatacctcagtgggagccctccaaagggtggaacgattggcaacaggtgccattctgctcacatcactttcatcagctaattatgaaggacggacgcgaaatcgtcgtgccttgtagaaatcaggatgagctggttggccgggccagggtgagtcaaggtgcagggtggtctctccgagaaacggcttgcttgggaaagagctacgcccagatgtggcagctgatgtatttccaccgtagagaccttcgcctggcagccaacgcgatctgttccgctgtccccgtggattgggtaccaacatcacggaccacttggagcattcacgcccatcaccaatggatgacaaccgaggacatgctctctgtttggaatagggtgtggatagaagagaacccctggatggaggataaaactcatgtctccagttgggaagaggtgccttacttaggcaagagagaagaccagtggtgcggcagcctgatcgggttgaccgcacgcgccacatgggctacgaatattcaggttgccatcaaccaggtgcggaggctgattggaaatgagaactatctcgactacatgacctcgatgaaacgatttaagaatgagtccgatccagaaggtgcactttggtga

SEQ ID NO: 13205 - RNA, 9879 nt, synthetic construct
  misc_feature 1..9879: note = derived and/or modified CDS sequence (opt3) from DENV-1__JX669461__SS-prME
  source 1..9879: mol_type = other RNA
agcgtgaccatgctgctcatgcttctgcccactgccttggctttccacttaactacgagaggcggggagcctcatatgatcgtctccaagcaggaaagaggaaaatctctgctgtttaagacctcagttggtgtgaacatgtgcacactcattgccatggacctgggcgagctttgtgaagatactatgacctacaaatgcccacggataaccgaggccgaaccggacgatgtagactgttggtgcaatgcgaccgatacttgggtgacatatgggacctgtagtcaaacgggagagcaccgccgagacaagcgtagcgtcgctctggcaccccatgtgggcttgggtctcgagactagaaccgaaacatggatgtcctctgagggggcatggaaacagatccagaaggttgaaacttgggccctgagacaccctggattcaccgtgattgctctgtttctcgcacatgccatcggcacatcgattacccagaagggcatcatattcatcttactgatgcttgtcacgccatcaatggctatgcggtgcgtggggattggaaaccgcgattttgtagagggtttgagcggcgccacttgggttgacgtggtcctggagcacgggagttgtgtgacaaccatggcgaaaaataagcccactctagatatcgaactcctgaaaacagaggtgaccaaccctgcagtccttagaaagctgtgcattgaagccaaaatctccaatacgaccacagactctaggtgtccaactcaaggagaggctaccttggttgaggaacaggatgccaacttcgtgtgccggcgcacatttgtagaccgaggctggggtaatgggtgtggactcttcggcaagggcagcctgttaacttgcgcaaagtttaaatgcgtgaccaagctggaggggaaaatagtccagtacgaaaacctcaagtattccgtgattgttacagtgcacaccggagatcagcatcaagtcggtaatgagactacggaacacggcacaatcgctaccattactccccaggcccctacctcagagatccagcttacagactacggggcgctgaccttggactgtagtccaagaactggactagatttcaacgaaatggtgctgctcacaatgaaagaaaagagctggctggtacataaacagtggtttcttgacctgccgttgccctggacgtctggcgcctccacctcacaagagacttggaataggcaggatctcctggttacattcaagaccgcacacgctaagaaacaggaagtggtcgtgttaggtagccaagagggggccatgcacacagctctgactggcgccaccgaaatccagacgagtggaaccacaactatttttgcaggccatctaaagtgccggctcaaaatggacaagctgacccttaaagggatgtcttatgtcatgtgtacaggatccttcaagttggagaaggaagtggccgagactcagcacggtaccgttctggtgcaggtaaaatacgagggcacggatgctccttgcaagataccattcctcacacaagacgaaaaaggggtcacccagaacggacgtctgatcactgcgaatcccattgtgacagataaggagaaacctgttaacatcgaaaccgagccaccctttggcgagagctatatagtggtcggtgcaggggaaaaggcccttaagctgtcgtggttcaaaaagggatcttccattggaaaaatgtttgaggctactgcccgcggcgcaagaaggatggccatcttgggggacaccgcttgggatttcggatcaatcggtggcctctttacaagtgtggggaagctgattcatcaggtattcggaacggcctacggcgtgttatttagcggtgtttcctggaccatgaaaatcgggattggcatactgctaacttggctcggactaaattctcggagcacatcacttagtatgacctgtatcgcagtcggcatggtgacattgtacctgggggtgatggtccaggcggactccggatgcgttattaactggaagggccgagaactcaagtgtggtagcgggatcttcgtgactaacgaggtgcacacctggacggaacaatataaatttcaggctgattctccgaagcgcctgtcagccgcaatcggaaaagcctgggaggagggcgtatgcggtattagaagtgctacaaggttagaaaatataatgtggaagcagatcagcaacgagctgaattacattcttttggaaaacgacatgaaattcaccgtcgtggttggcgacgtgaatgggatcctcgcccagggaaagaaaatgattcggcctcaacccatggagcataagtattcctggaagtcttggggcaaagcaaagatcataggggctgatatccagaacactacctttattatcgacggaccagatacacctgaatgtcccgacgatcagcgcgcctggaatatttgggaggtcgaggactacggcttcggtatctttactaccaacatatggctgaaactaagagattcgcacacacagatgtgcgaccacaggctgatgagcgcggccattaaggattccaaagctgtgcatgcagacatggggtattggatcgaatcagagaagaatgaaacgtggaagctcgcccgtgctagtttcattgaggttaaaacctgtatctggccaaagtctcacactctgtggagcaacggagtgcttgaatccgagatggtaatacccaaaatctacggcggtcctatttcacaacataattatcggccaggctacttcacacagaccgccgggccgtggcacttgggaaagctggagttagattttgacctctgcgaaggcactacagtcgtggtggatgagcactgcgggtaccgaggacccagcctgagaaccacgactgtcaccggcaaaatcattcatgaatggtgttgcaggtcttgtacacttcctccactgcgcttccggggtgaggacgggtgctggtatggaatggagatcagacccgttaaggaaaaggaggaaaacttggtgaggtccatggtaagtgcaggcagcggtgagatggactctttttccctcggcatactgtgtgtgtcaattctaatcgaagaggtcatgcgcagtcgatggagccggaaaatgctgatgaccgggactctcgcggtgttcctgcttttgatcatgggacagctgacatggaatgatttaattcgtctctgcatcatggttggcgccaacgcttcggacaagatggggatgggaaccacatacctggcccttatggcaactctgaaaatgagacctatgtttgctgtgggcctactcttcaggcgcctgacctcccgggaggtcttgctgttaacggtgggtctctctctggttgccagcgtggaacttccaaattcactggaggaattgggggatggactcgcaatgggcattatgatgctgaagctactgacagactttcaaccccaccagctttggaccactctcctgagtttgaccttcataagaacatccctgtctttagattatgcctggaaaactatggctatggcgctcagcatcgtctccctgtttccgctttgtctgtcaaccacgagccagaagacaacctggttgcctgtactcctgggcagtttcgggtgcaagccactaactatgtttctgattacagagaacaaaatctggggaaggaagtcttggcccattaacgaaggtatcatggccgtgggcatagtttccatccttctcagctcgctgttgaaaaatgacgtgcctttagcagggcccctgattgctggaggcatgctcatcgcctgttacgtcatttcaggttctagtgccgatctgtcccttgagaaggctgcagaggtgagctgggaagaggaagccgagcattctgggaccagccacaacatcctggtagaagtgcaggacgatggaactatgaaaataaaggacgaggagcgagatgacacattgaccattctactgaaagcgacgctcctggctgtctccggcgtttatccaatgtcaatccctgccactcttttcgtgtggtacttttggcaaaagaagaaacagcgcagtggcgtgttatgggatacccccagcccaccggaagtcgagcgggcagtgctggacgacgggatctataggattctccagaggggattgctgggtcgttctcaggttggcgtaggggtgttccaagatggagtcttccatacaatgtggcacgtgacccgcggcgccgttctcatgtaccagggtaagcggctggaaccttcctgggcttcagtgaaaaaggaccttataagttacgggggaggctggagatttcagggcagctggaatacaggggaggaggtccaggtgatcgcagtagaacccggcaagaacccaaagaatgtccaaactacccccggtacgttcaagacacctgagggcgaagtgggggccattgcgctggattttaaaccaggaacttccggctctcccatcgttaacagggagggtaagattgtggggttgtatggaaatggcgtcgtgaccacatcgggcacctacgttagcgctatcgcccaggcaaaagccactcaggaagggcctctaccggagatagaggacgaagtgttcaagaaacgaaacctgaccatcatggatctccacccaggatcaggtaagacacggcgctatttacccgctattgtcagagaggccatcaagaggaaactgcggacgcttattctggcacctactcgagtggtagcttccgaaatggccgaggcgctcaagggcatgccaatcagataccaaaccacagccgtgaaaagtgaacataccgggcgcgagatagttgacttgatgtgccacgcaacttttacaatgaggctgctctctcccgtccgtgtgcctaattataacatgattatcatggatgaggctcatttcaccgacccggccagcatcgctgcacggggatacatttccacgagagtgggcatgggtgaagccgccgctatctttatgactgcgacacccccagggtcagtcgaggcattccctcagtctaatgccgtaatacaggatgaagagagggacattcccgaacgcagctggaacagtggatatgattggatcaccgactttccaggcaagaccgtgtggttcgttccttccattaaaagcggcaatgacatcgctaactgtctgcgaaagaatgggaagagagtgatacagctttctcggaaaacttttgatacagagtaccaaaagaccaaaaacaacgactgggattacgtcgtgacaactgacatttcagagatgggagccaatttcagggcagatcgcgttatcgacccccgtagatgcctaaagccagtgatcctgaaagaaggtccggagcgggtcattttggccggccctatgcccgtgacggtagcttccgcggcccagaggcgcgggcgaatcggaagaaaccagaataaggaaggcgatcagtatatttacatgggtcaaccattaaacaatgacgaggatcacgcacattggaccgaggctaagatgctgctcgacaacataaatacacccgaagggatcattcctgccctgttcgagccagaacgggagaaaagtgcagccatcgatggcgaatataggcttcgcggagaggctagaaagacttttgtggagctgatgaggcggggcgacctccccgtttggttgagctacaaagtcgcctcggaagggttccagtattctgatcgtcgctggtgctttgacggagagcgaaacaatcaggtgctggaagagaacatggacgtggaaatctggaccaaggagggtgagaggaaaaagctaaggcctcggtggctggatgcgcgcacatactccgacccgctcgcacttagagagttcaaagagtttgccgctggcaggcggagcgtctcaggggatctgattttagaaataggaaagttgccacagcacctgaccctccgagcccaaaatgctctggacaaccttgttatgctgcacaatagtgagcagggcggtaaggcatatagacatgccatggaggaactccccgatactatcgagacgttgatgctgttagctctaattgccgtgctgaccgggggcgtaacactcttctttctttctggaaaaggcctggggaagacttccatcggattgctgtgtgtgatggcaagctcagcgctcctgtggatggccagtgtcgaacctcactggattgctgccagcatcatacttgagttctttctcatggtgctgttgatccccgaaccagaccgccagaggacccctcaggataaccaactggcatacgttgtgattggtttactattcatgatcctgacagtcgctgccaatgagatgggcctccttgagaccactaaaaaggacctggggattggacatgtagcagtggaaaaccaccaccatgccacaatgttggatgttgacctgcggcccgcttccgcgtggacgctctacgccgtggcaaccactgtcatcacaccaatgatgcgtcacaccatagagaacaccacagctaatatttctctgactgccatcgccaaccaggcagctattcttatgggcttagataaaggttggcctatcagcaagatggacataggggtgccgctgctcgccttgggctgctattcccaggtcaatcccctgacgctaaccgcggctgtgctgatgctcgttgcccattacgcaatcattggaccaggccttcaagccaaggctacaagagaagcacagaaaaggactgccgcggggatcatgaagaaccctaccgtggatggaattgtaacaatcgacctggaccccgtggtctatgatgctaaatttgagaagcagttgggccagataatgctgctcattctgtgtacctcacaaatcttacttatgcgcactacgtgggccctgtgcgaatctatcacactcgcaaccggtccactaactaccctgtgggaggggagtcctggaaaattctggaatacaactattgccgtttcgatggctaacatctttcggggcagctacttggccggtgcaggcctggctttctccctcatgaagtctcttgggggaggccgaagagggaccggagcccagggcgagacactgggtgaaaagtggaaaaggcagttgaatcagctgtcaaagagcgagttcaacacgtataaaaagtccgggataatggaagtggaccgcagtgaggcgaaagaaggactcaagcggggcgagaccactaagcacgccgtctctagaggtacagcaaaattacgttggtttgtggagaggaatctggtaaagcccgaaggcaaagtgattgatcttgggtgtggacggggcgggtggagctactattgcgctggactgaagaaagttaccgaggtgaagggctacactaaaggtgggccgggacatgaggaaccaatccctatggccacatacggctggaacctagtcaagctccactcaggcaaggacgtgttctttacacccccagaaaaatgtgatacgctgttgtgcgacattggggagtccagtcccaatcctaccatcgaggaaggacgcacactgcgagtcctcaagatggtggagccgtggcttagaggtaaccaattctgtataaaaatcctgaatccctatatgccaagcgttgtagaaactttagagcagatgcagaggaagcacggcgggatgctggtgcggaaccctttgtctcgcaattccacccatgagatgtactgggtctcatgcggaacaggcaacattgtgagcgcagttaatatgacttcgagaatgctcctgaacaggtttaccatggctcaccgaaaacccacatatgaacgggatgtggacctaggtgccgggacccgtcatgtcgccgtggagcctgaagtagcgaaccttgatatcattggacagagaatcgagaatattaagaacgaacacaagtctacttggcactacgacgaggataatccatataaaacgtgggcttaccatggcagttatgaggtgaagccctccggcagcgcatcatccatggttaacggggtcgtgcgcctgctcacaaaaccttgggacgtgatcccaatggtcacccaaatagccatgactgacaccacacccttcggacagcagagggtttttaaggaaaaagtggatacgcggaccccgagagctaagcgcggtactgcccaaattatggaggtaacagcaaagtggctgtggggcttcttgtctaggaataaaaagcctcgaatctgtacccgggaagagtttactagaaaagtgaggagcaacgccgctatcggggcggtcttcgtggacgaaaatcagtggaacagtgccaaggaggcagttgaggatgaacgcttttgggacctggtgcaccgtgagcgggaactccataaacagggaaagtgcgctacatgcgtctacaatatgatgggcaagagagagaagaaacttggtgagttcgggaaagccaaaggatccagggcaatttggtacatgtggctgggcgcccgctttttagagttcgaggctctgggcttcatgaacgaagatcactggtttagccgagaaaattctttgtcaggggtggaaggagagggtctccataaactgggctatatactacgggacatcagtaagattccagggggaaacatgtacgccgatgacaccgcgggctgggatacaagaatcactgaggacgatcttcagaatgaagcaaaaattaccgacatcatggagcccgaacacgccctgctcgctacgtccatattcaagctgacctatcaaaacaaggtagttagggtgcagcgccctgccaaaagcggtacagtcatggatgtgatctctagacgggaccagagggggtcgggacaggtgggcacttacggcttgaatacctttacaaacatggaggtccaattaattcgtcagatggaatcagaggggatcttcagcccatccgagctggaaactcccaacctcgcaaagaaagttcttgactggctggagaagcacggagctgaacgactaaaacgcatggccattagtggtgatgactgtgtggtaaagccgatcgatgacagatttgctaccgccctgacggcactcaatgatatgggcaaggtgcggaaagacatacctcagtgggagccctctaaggggtggaacgattggcagcaagtcccattctgcagccatcactttcatcagttgattatgaaagacggaagggaaatcgtggttccttgtcgcaatcaggatgagctggtgggcagagcgcgggtctcccagggtgccgggtggtcacttagggagacagcttgcctgggaaagagttatgcccaaatgtggcagctcatgtacttccaccgacgtgacttaagactggcagctaacgccatctgttctgcagtgcccgtagattgggttccaaccagccgcactacatggtccattcacgcccatcaccagtggatgaccactgaagacatgttgtcagtgtggaatcgggtctggatagaggaaaacccctggatggaggacaaaacccatgtgagctcttgggaagaggttccttatctgggcaagagggaggatcaatggtgcggctccctcatcgggcttacagcgagagctacgtgggccaccaatattcaggtggcaatcaaccaggtccgccggctgattggaaatgaaaactacctagactacatgacaagtatgaagaggtttaaaaatgagagcgatccagaaggtgccctgtggtga

SEQ ID NO: 13206 - RNA, 9879 nt, synthetic construct
  misc_feature 1..9879: note = derived and/or modified CDS sequence (opt3) from DENV-1__KF184975__SS-prME
  source 1..9879: mol_type = other RNA
agcgtgaccatgctgctcatgcttatgcccacagcactggctttccacttgactacgagaggcggggagcctcatatgatcgtctccaagcaggaaagaggaaaatctttactgtttaagacctcagccggtgttaacatgtgcacactgattgccatggacctcggcgagctgtgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggttgacgttgtgttggagcacgggtcctgtgtcacaaccatggcaaaggataaacccactctggacatcgaactactcaagacagaggtgaccaaccctgccgtgctgaggaaactttgcattgaagctaagatctctaatacgaccacagatagccggtgtccaactcaaggagaggccaccctggtcgaagaacaagacgcaaacttcgtttgccgccgaacatttgtggatagaggctggggtaatgggtgtggattgttcggcaaaggctccctcctgacttgcgctaagtttaagtgcgtaaccaaattagaggggaagatagtgcagtacgaaaacctgaaatattcagtcattgtgacagttcacaccgaggaccagcatcaagtgggaaatgaaactacggagcacggtacaatcgccaccattactccccaggcgcctaccagtgaaatccagctcacagactacggcgcccttaccctggattgtagcccaaggactgggttggacttcaacgagatggtcctactgacaatgaaggagaaatcttggctcgtgcataagcagtggtttctggatcttccgctgccctggacgtccggagcatcaaccagccaagaaacttggaatcggcaggacttgctcgtaacattcaaaaccgctcacgccaagaagcaggaggttgtggtcctgggcagtcaagaaggtgctatgcacacagccttaactggggcaaccgagatccagacgtctggcaccacaactatttttgccggacatctgaaatgccgtctaaagatggataaactcaccctgaagggcatgtcctatgtgatgtgtacagggagcttcaaacttgaaaaggaggtcgctgagactcagcacggaaccgtgttggttcaggtgaagtacgaaggtacggacgcgccttgcaaaataccattctcgatccaagatgagaagggcgtaattcagaacgggcgcctgatcacagcaaatcccatagtcaccgacaaagaaaagcctgtgaacattgagactgagccaccctttggagaatcttatatcgttgtgggcgccggtgagaaaacactcaagctgtcctggttcaagaaagggtcaagtatcggcaagatgtttgaagctaccgccagaggagcaaggcggatggccattcttggcgatactgcttgggacttcgggagcatcggaggtgtctttacctccgtgggcaaactggtacatcaggtgttcgggacagcctacggagttttgttttctggcgtcagctggacgatgaagattggtatagggatcctcctgacctggttaggcctaaattcacgaagtacttccctaagcatgacatgtattgcagtgggaatggtgaccctctacctgggcgtcatggttcaggcggattctgggtgcgtgatcaactggaaaggacgcgagcttaagtgtggctcaggtatcttcgtgacaaatgaagtacacacttggaccgagcaatataagtttcaggctgacagtccgaaaagattgagcgccgcaattgggaaggcctgggaggaaggagtctgcggcataaggtccgctacgcggctggagaacgtgatgtggaaacagatctctaacgaactcaatcatattctgttagagaacgacatgaagttcacagttgtggtcggtgatgtgaatggcatcctggcccaggggaaaaagatggttcgccctcaacccatggaacacaaatactcgtggaaaagctggggaaaggcaaagattatcggcgctgacatacagaacaccacttttatcattgatgggccagacacccctgagtgtcccgatgaccagagagcctggaatatctgggaggtggaagattatggattcggcatttttacaactaacatctggcttaagttgagggactcctacacccagatgtgcgatcaccgtctcatgtcagcggccataaaagacagtaaggctgtacatgcagatatgggttattggattgagtctgagaagaatgagacatggaagctggcccgggctagcttcatcgaagtcaagacgtgtatttggccaaaatcccacaccctatggtcaaacggggtgctggagagcgagatgatcatacccaagatctacggaggccctacttctcaacataattatcgaccaggttacttcacacagaccgccggcccgtggcacctcgggaaactggaacttgactttgatttgtgcgagggaactacagtggtcgttgacgaacactgcggcaacagagggccctccctgaggaccacgactgtgaccggaaagattatccatgagtggtgttgccgcagttgtacattacctccactccggttcaaaggcgaggacggttgctggtacgggatggaaattagacccgtaaaggagaaggaagagaatctggtgaggagcatggtctctgcaggatccggcgaagtggataacttttcacttggtctgttgtgtgttagtatcatggtggaggaggtcatgcgcagccgatggtcgcggaaaatgctcatgaccggcactctggcggtgttcctactgctcataatggggcagctgacatggaatgaccttattcgtttgtgcatcatggttggagccaacgcttccgatagaatgggcatggggaccacatatctggccttaatggcaacttttaagatgaggcctatgttcgctgtgggactcctgtttcgccggcttacctctagagaagtcctgctactcacgatcggcctgagcttggtagcctcagtggagctgccaaatagtttagaagaactcggtgacgggctggcaatgggaattatgatgcttaaactgttgacagatttccaatcccaccagctctggaccactctgctatctctgacctttgttaagacaactcttagcctcgactacgcctggaaaaccatggctatggtgctgtccatcgtctcattgttccccctgtgtttaagcacgacaagtcagaagaccacttggctcccggtgctgcttggctcttttggctgcaagcctctgacaatgttcttgattaccgaaaacaaaatatgggggaggaagtcctggccactcaacgagggaatcatggcggtaggtattgccagcatcctgctatcgtcactgcttaaaaatgatgtgcccctcgcaggccctctgattgctgggggaatgttgatcgcctgttatgtcatatctggcagttccgccgacttaagcctggagaaggctgcagaagtttcttgggaggaagaggccgaacatagcggtgcgtcccacaacatcctcgtggaggtgcaggatgacgggactatgaaaattaaggatgaggaacgagacgatacactgaccatccttctgaaagctacgttgctagccgtctcaggagtgtaccccatgagtattccagcaactctgtttgtttggtatttctggcaaaagaagaaacagcgcagcggcgtactctgggacaccccttctcccccagaggccgaaaaggctgtgctggacgatggcatctaccggatacttcagagagggttactgggaaggtcccaggtcggtgtgggcgttttccaagacggggtgtttcatacaatgtggcacgtcacccgtggagcagtgctcatgtatcagggcaaacgcgtagagccgtcatgggccagtgtcaagaaagatttgattagctacggtgggggatggcggttccagggcctgtggaatacaggcgaggaagtgcaggttatcgcggtggagcctgggaagaaccccagaaatgtccaaactaccccaggaacgtttaagacacccgaaggtgaggtgggcgctatcgccctcgacttcaaacctgggacttccggatctccaattgttaacagggaaggcaagatagtgggtctgtacgggaatggagtcgtgaccacatcgggcacctatgtaagcgcaatcgcccaggctaaagcctcacaggagggcccccttcctgagattgaagatgaggtgtttcgaaagcggaacctgactatcatggacttgcacccggggtccggaaaaacccgcagatacctaccagcaattgttagggaagctatcaagcggaagctgcgaacactcatattagcccccacgagagtcgtggcgagtgagatggccgaagcactgaaaggtatgcctatccgctatcaaactaccgctgtgaagacagagcataccggcagggagattgtcgatcttatgtgccacgccactttcacaatgcgtctgctctctccagtacgggtgcccaattacaacatgatcattatggacgaagctcattttaccgatcctgcaagcatcgccgccagagggtatatatccacgagggttggaatgggcgaggctgcggcaattttcatgactgccacaccgcccggttcaatggaggcttttccacagtctaatgccgtgatccaggacgaggaacgcgatatccctgagcgaagctggaacagtgggtacgactggattaccgacttccccggaaaaaccgtctggtttgtgccatccatcaagagcggcaatgatatagcaaactgtttgaggaagaatggcaagcgggttattcagctgtctaggaagactttcgacacagagtatcagaaaaccaagaacaacgattgggactacgtggtcacaactgatatctcagaaatgggggccaatttccgcgctgaccgtgtgattgatcctagacggtgcctcaaacccgtaatcctgaaggacggaccagagagggtgatacttgcgggtccgatgcctgttacggtcgcctccgcagctcagcgccgaggcagaattgggcggaaccagaataaagaaggagatcagtacgtgtatatgggccaacccctaaacaatgacgaggatcacgcccattggaccgaggcaaagatgctgttggacaacatcaatacaccagaaggtatcattcccgccttatttgagcctgaaagggagaagagtgctgccatcgatggggaataccgcctgagaggcgaggcgaggaaaactttcgtggagctcatgcggcgtggagacctgccagtctggcttagctataaggttgcatcggaaggctttcagtactctgaccgccgatggtgcttcgatggggagagaaacaatcaggtgctggaagagaacatggacgtagaaatttggaccaaagagggagagaggaagaaactccggccccgctggttggatgccagaacatattccgaccctctggctctaagggaatttaaggagttcgccgctggtcggcgaagcgtgtcaggcgatctgatactcgaaatcgggagacttccgcagcacctgaccttaaaagcacaaaatgccttggacaacctggtcatgctccacaatagtgagcagggaggcaaggcttaccgccatgccatggaggaactgccagatactattgagacgcttatgctgctcgcattgatcgcggtgctgaccggtggggttacattatttttcctatctggcaagggactgggcaaaacttccatcgggctcctttgtgtgatggccagctcagtcctgttgtggatggctagtgtagaaccccactggattgccgcaagcataatcctggagtttttcctcatggtgctgcttattcctgaacccgacaggcagcggaccccacaggataaccaactcgcttatgttgtgatcggactgttgtttattatcctgacagtcgccgcaaatgagatgggtttactagagaccactaagaaagacctgggcatagggcatgtggccgctgaagatcaccagcacgcgacaatgctcgacgtcgatcttcgtcctgcctccgcatggacgctgtacgctgtggccaccactatcattacacccatgatgagacataccatcgagaacaccacagccaacatttctttgactgcaatcgctaatcaggccgcgatactgatgggactcgacaagggctggccaattagcaaaatggacatcggtgttcctctgcttgctttagggtgctactcccaagtgaacccgctgacgctcaccgccgcagtattgatgctggtggcccactatgctattatcggccccggactacaggcaaaggccacaagggaagcgcagaagcgcactgctgccggcataatgaaaaatccaaccgtcgatgggatcgttgcaattgacctggatcctgtggtctacgacacaaagttcgagaaacagctcggacaaatcatgcttctgattttgtgtacctcacagatcctgctcatgcggactacgtgggccctgtgcgaatctataacattagctaccggcccccttactaccctgtgggagggtagtccagggaagttttggaacacaactattgccgtgtcgatggcaaatatcttccgaggaagctatctcgctggcgccggtctagcgttctccctgatgaaatctttgggcgggggaagaaggggcaccggggcccagggagagacactgggcgaaaagtggaagcgccagctcaaccaactttcaaaaagcgagtttaatacgtacaagcggtccggtatcaccgaagtagatagaagtgaggcaaaagaagggctgaagcgtggagagactacaaaacatgctgtgtctaggggcgccgcaaagttgcggtggttcgttgagcgcaacctggtgaagcctgaaggtaaagtcattgacctcggctgtgggcgaggaggctggagctattactgcgctgggttaaagaaagtgaccgaggtcaagggatatactaaaggcggtcccgggcacgaggaaccgatcccaatggccacatacggatggaatctggtgaaacttcattcaggcaaagatgtatttttcatacctcccgaaaagtgtgacaccctgctatgcgatattggcgagtccagtccaaaccccacgatcgaggaagggagaaccctcagggtactgaagatggtggagccttggttgcggggaaatcagttttgtattaaaatcctgaacccgtacatgcccagcgtcgtggaaacactcgagcagatgcagcgcaagcacggtggcatgcttgttagaaatccactgtctaggaactccactcacgagatgtattgggtgtcatgcgggaccggaaatatagtcagcgccgtgaacatgacatcgcgaatgttactgaatcggttcactatggcgcatcgtaaacctacctacgaaagagacgtagatttgggcgctggtacacgccacgtggcagttgagcccgaagtcgccaacctcgacatcattgggcaaaggatcgagaacattaagaatgaacataaatctacctggcactatgacgaggataacccttacaagacttgggcttatcacggaagttacgaggtgaagccatccggcagcgcctcatccatggtgaatggcgtcgttcggctgctaacgaaaccctgggacgtgatccctatggtaacacagattgcaatgaccgatactaccccatttgggcagcaaagagtgttcaaggaaaaagtcgacacacgcacgcccagggccaagcgaggaaccgctcagatcatggaggtgactgcgaaatggctttggggttttctgtctcggaacaagaagccgagaatatgtacaagggaagagttcacccgcaaagttcgtagcaatgccgcaattggcgctgtgtttgtcgatgaaaaccagtggaatagtgccaaggaggcagtggaggacgaacggttctgggatctcgtacatagagagagggaactgcacaaacaggggaagtgcgccacttgcgtttataacatgatgggaaaacgcgagaagaagttgggcgaatttggtaaagctaaggggtcccgagccatctggtacatgtggctgggagcgcggttcctcgagttcgaggcacttggctttatgaatgaagaccattggttcagcagagagaactctctgtcaggcgtggaaggggagggattacacaaactgggttacatcttgagggatattagtaagatacctggcgggaatatgtatgccgacgatacagctggatgggacacccgcatcacagaggatgacctccaaaacgaagccaaaattactgacatcatggagccagaacatgcactgctagctacctccatttttaaacttacgtaccagaataaagtcgtgagagtgcagcggcccgccaagagcggcaccgtcatggatgttatctctaggcgtgaccagcgaggttcggggcaagtgggaacatatggcctgaacactttcaccaatatggaggtacagctcatacgccagatggaatcagagggcatctttctgcctagcgagttggaaacaccaaacttagctgagagagccctggattggctcgaaaagcacggggtggagcggcttaaaaggatggcaatttccggagacgattgtgtcgtgaagcccactgacgatcgcttcgcgaccgccctgacggctctaaacgacatgggtaaagttagaaaggatatcccgcagtgggaacctagtaaaggctggaatgactggcaacaggtgcccttttgctctcaccatttccaccagctgattatgaaggatgggcgggagatcgtcgtgccatgtaggaaccaggacgagctcgtaggacgagcccgtgttagccaaggcgcaggttggtccttgagagaaacagcttgcctggggaagtcatacgcccagatgtggcagcttatgtattttcatcgccgggacctgaggctcgcagccaatgcgatatgtagtgctgtgcctgtcgattgggtgcccacctctagaactacatggagcattcacgcccaccatcaatggatgaccactgaggacatgttatccgtttggaaccgcgtgtggatcgaagagaatccatggatggaagataaaacccacgtctcaagctgggaggacgtgccctacctgggaaagcgggaggatcagtggtgcggctctttgatcggcctgacagcaagggccacgtgggctaccaacattcaggtagccataaatcaggtgcgaagactcatcgggaacgaaaattatcttgactacatgacttccatgaaacggttcaagaacgagagtgatcctgaaggagcactgtggtga

SEQ ID NO: 13207 - RNA, 9879 nt, synthetic construct
  misc_feature 1..9879: note = derived and/or modified CDS sequence (opt3) from DENV-1__KT831765__SS-prME
  source 1..9879: mol_type = other RNA
agcgtgaccatgctgctcatgcttatgcccacagcactggctttccacttgactacgagaggaggggaacctcatatgatcgtctccaagcaggaaaggggaaaatctttactgtttaagacctcagccggtgttaacatgtgcacactcattgcaatggacctcggcgagctgtgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaactactcaagacagaggtgaccaaccctgccgtgctgaggaaactttgcattgaagctaagatctctaatacgaccacagatagccggtgtccaactcaaggagaggccaccctggtcgaagaacaggacgcaaacttcgtttgccgccgaacatttgtggatagaggctggggtaatgggtgtggattgttcggcaaaggctccctcataacttgcgctaagtttaagtgcgtaaccaaactggaggggaagattgtgcagtacgaaaacttaaaatattcagtcatcgtgacagttcacaccggagaccagcatcaagtgggtaatgagagtactgaacacggcacgacagccaccattactccccaggcgcctaccacagagatccagctgaccgactacggggccctcactcttgattgtagcccaaggacaggactggacttcaacgaaatggtcttgctaacgatgaaggagaaatcttggctggtgcataagcagtggtttctcgatctgccgcttccctggacctccggcgcatcaactagccaagagacatggaatcggcaggacctgttggtaaccttcaaaacagctcacgccaagaagcaggaagttgtggtcctcggtagtcaagagggggctatgcacactgccctgaccggcgcaacggaaatccagacctctggaacaactaccatttttgccggccatttaaaatgccgtctgaagatggataaactaacactcaaggggatgtcctatgtgatgtgtactggtagcttcaaactggagaaggaagtcgctgagacccagcacggaacggtgcttgttcagataaagtacgagggcacagacgcgccttgcaaaatcccattctcgacccaagatgaaaagggggtgactcagaacggacgcttgattacagcaaatcccatcgtaaccgacaaagagaagcctgtcaacatagaagccgagccaccctttggcgagtcttatattgtgatcggtgctggggaaaaagccctgaagctctcctggttcaagaaaggctcaagtatcggaaagatgtttgaggcaactgccagaggcgctaggcggatggccattctgggggataccgcatgggacttcggaagcatcggtggcgtttttacatccgtggggaaacttgtccatcagattttcggaacggcgtacggcgtgctgttttctggtgtaagctggaccatgaagatagggatcggcgtgttgctcacttggctgggattaaattcacgaagtacatccctgagcatgacctgtattgctgttggcctagtcacactctacctgggggtgatggtgcaggccgattctggatgcgtcatcaactggaaaggccgcgaacttaagtgtggttcagggatcttcgttactaatgaggtgcacacctggacggaacaatataagtttcaggcagacagtccgaaaagattgagcgccgctattggaaaggcctgggaggagggcgtgtgcggtataaggtccgcaacacggctggaaaacatcatgtggaaacagatttctaacgagctcaatcatatcctgttagaaaacgacatgaagttcaccgtagtcgtgggcgatgttgctgggattctggcccagggcaagaagatgatccgccctcaacccatggagcacaaatactcgtggaaaagctggggcaaggcgaagataatcggggccgacgtgcagaatactacctttattatcgatggaccaaacacacctgaatgtcccgacgatcagagagcttggaatatttgggaggtcgaggactatggcttcggtatctttactaccaacatatggcttaagttgagggattcctacacacaggtgtgcgaccaccgtctcatgtcagcagccattaaagatagtaaggctgttcatgccgacatggggtattggatcgaatctgagaaaaatgaaacgtggaagctggcacgggcgagcttcattgaggtgaagacctgtatctggccaaaatcccacactctatggtcaaacggagtactggaaagcgagatgataatccccaagatttacggcggtcctatctctcaacataatcaccgaccaggctatttcacacagaccgccgggccgtggcacctcggaaaactggagcttgattttgacttgtgcgaaggcactacagtcgtggtggatgagcattgcgggaacagaggaccctccctgaggaccacgactgtcaccggcaagattatccacgaatggtgttgccgcagttgtacattacctccactccggtacagaggtgaggacgggtgctggtacggaatggagataaggcccgttaaagaaaaggaggaaaatctggtgaagtccatggtatctgctggctccggtgaggtggactcattcagtcttggcctgttgtgtattagcatcatgatcgaagaggtcatgcgctcgcgatggtcccggaaaatgctcatgaccgggactctggccgtgtttttcctactgattatgggacagctcacatggaacgatctgatccgtctttgcattatggttggcgcaaatgcttctgacagaatggggatgggaaccacatatttggccctgatggcaacttttaagatgaggcctatgttcgccgtgggcttactctttcgccggctgaccagcagagaggtccttctgctaacgataggtctctcactggtggctagtgttgaattgccaaactccctggaggaattaggggatggactcgcgatgggcatcatgattctgaaacttctgacagacttccaatctcatcagttgtgggccaccctcctgagcctaacttttatcaagaccacattctccctgcactacgcatggaaaactatggctatggtgctttcaattgtcagcctctttcccctgtgtttgagtaccacgtctcagaagacaacctggctgccggtattactcggctccctggggtgcaagcctcttactatgttcctgatcgccgagaataaaatatggggaagaaagagctggccattgaacgaaggtatcatggccgtgggcattgtttcgatcctcctgtcatctctactgaaaaacgatgtgccccttgctgggcctctcattgcaggaggcatgctgatcgcctgttatgtcataagtggttccagcgcggacttgtctttagagaaggctgccgaggtgagctgggaagaggaagcagagcattccggggcctcacacaatattctggtagaagtgcaggatgacggaacaatgaaaatcaaggatgaggagcgagacgataccctcactatcctgcttaaagctacactgttggcagtcagtggcgtttaccccctaagcattccagccaccctgtttgtgtggtatttctggcaaaagaagaaacagcgctctggcgtgctctgggacacgccttcacccccagaagtcgagcgggcggtgctggatgacgggatatacagaatcatgcagaggggacttttaggtcgtagccaggttggcgtaggggtgttccaagaaaacgtctttcacactatgtggcatgtgacccgcggagctgttctgatgtatcagggcaagcggctcgagccgagttgggccagcgtgaaaaaggacttgatttcctacggtgggggatggagactgcagggctcttggaatacaggcgaggaagtccaggtgatcgcagtagagcctgggaaaaaccccaagaatgtccaaaccgccccaggaacattcaagactcccgaaggtgaggtgggcgctattgccctcgattttaaacctgggacctcgggaagcccaatcgttaacagggaaggcaagatagtgggtctgtacgggaatggagtcgtgacgacatcaggcacttatgtttccgcaatcgctcaggccaaagcgagtcaggagggcccccttcctgagattgaagacgaggtgttccgaaagcggaacctgaccatcatggatttgcacccggggtctggaaaaacacgcagatacctaccagccattgtcagggaagcaatcaagcggaagctgcgaaccctcatattagctcccactagagtggtagccagcgagatggctgaagcactgaaaggtatgcctattcgctatcaaaccacagccgtgaagtccgagcatacgggcaaagagatcgttgaccttatgtgccacgccacttttaccatgaggctgctctcaccagtccgtgtgcccaattacaacatgatcattatggatgaagctcatttcacagacccttctagcatcgcggcacgggggtatataagtaccagagtgggaatgggcgaggccgctgccatttttatgactgcaacaccgcccggttccgtcgaagccttcccacagagcaatgctgtaatccaggatgaggaaagggacattcctgagcgctcttggaactcagggtacgagtggatcaccgattttcccggaaagacggtgtggttcgttccatccataaaaagtggcaatgacattgcgaactgtttgcgaaagaatggcaagagagtgatccagctgagccggaaaacttttgatacagaatatcaaaagaccaaaaacaacgactgggactacgtcgtgaccactgatatctcggagatgggggccaatttcagggcagaccgcgttattgatcctcgtagatgcctcaagcccgtgatcctgaaagacggaccagaacgggtcattcttgctggtccgatgcctgtgacagtagcctctgcagcccagaggcgcggccgaatagggagaaaccacaataaggagggagatcagtacatctatatgggccagcccctaaacaatgacgaggatcacgctcattggaccgaagccaagatgctgttggacaacattaatacaccagagggtatcatccccgcgttattcgaacctgagcgggaaaaatccgcagccattgatggggagtacaggctgcgcggcgaggctagaaagacttttgtggaactcatgaggcggggagacctgccagtttggcttagctataaagtcgcctcagagggcttccaatacagtgatcgtcgctggtgctttgacggggaacgaaacaatcaggtgctggaggaaaacatggatgtggagatatggacgaaggagggagaaaggaagaagctcaggccccggtggttggacgctcgcacctattctgaccctctggcactaagagagttcaaagaatttgccgctggtaggcggtccgtcagcggcgatctgatcctcgagattgggaaacttccgcagcacctgacacagcgagcccaaaatgcattagacaacttggttatgctgcataattcagaacagggaggcagagcgtaccgccacgccatggaggagctcccagatactatcgaaaccctgatgcttctggctctcattgccgtgttgacaggtggggtaaccctgttctttttaagtggcaagggactaggcaaaactagcatcgggctgctctgtgtgatggcatcctctgtccttctgtggatggctagcgtggagccccactggatagccgcatccatcattttggagttctttctgatggttctcctgatccctgagcccgacaggcagcggacgccacaggataaccaacttgcctatgtggtcattggaatgctattcatgatcctgaccgtagctgcgaatgagatgggtttgctggaaacaactaagaaagacttaggcatagggcatgtggccgttgagaaccaccatcacgcagctatgctagatgtggacctgcatcctgcctcagcctggaccctctacgcagtcgctacaaccattatcactcccatgatgcgtcacacaattgaaaacacgaccgccaatatctctcttactgcgatagctaaccaggccgcaatcctgatgggattggataagggctggccaattagtaaaatggacatcggtgtgcctctgctcgccctggggtgctactcgcaggtcaatccgcttacattaaccgctgcagtgctgatgctcgttgcccactatgcgattatcggccccggattgcaagctaaggccaccagagaggcacagaagaggacagccgctggcataatgaaaaacccaactgtggatgggattgtagccatcgacctggatcctgtggtctacgacgcaaagtttgaaaaacagctaggacagatcatgctgctcattctttgtacgagccaaatcctgttgatgcgcaccacatgggctctgtgcgagtccataactctcgccaccggccccctgacaaccttatgggagggttctccagggaagttctggaatactacgattgcggtttcaatggccaacatctttcggggaagctatcttgcaggcgctggtctggccttctccctcatgaaaagtctaggcgggggacgaagaggcacaggggcacagggagaaaccctgggcgagaagtggaagaggcagttgaatcagctgtctaaaagcgagttcaacacttacaagcgctcaggtattatggaggtggaccggtccgaagctaaagaggggctcaagagaggagagaccacaaaacatgccgtcagtcgtggcactgccaaacttaggtggtttgtggaacggaatctggtaaagcctgagggtaaagtgatcgatttgggctgtgggcgcggaggctggagctattactgcgcggggctgaagaaagttaccgaagtgaagggatatacaaaaggcggtcccgggcacgaggaaccgataccaatggctacgtacggatggaacctcgtcaagttacattctggcaaagacgtgttctttgtccctcccgagaagtgtgataccctgctttgcgacatcggcgagtcctcaccaaatcccactattgaagaggggcgaacactgagagtgctaaagatggttgaaccttggctcaggggaaaccaattctgtatcaaaattctgaatccgtacatgcccagcgtagtggagaccttggagcagatgcagcggaagcacggtggcatgctggtccgcaacccactctcgagaaattctactcacgaaatgtattgggtgagttgcgggacaggaaacatcgtttccgcaattaatatgaccagcaggatgcttctgaaccgatttacgatggcccatcggaaacctacctacgagcgtgatgtggacttaggcgctggtacaagacacgtcactgtggaacccgaggtagccaacctggatatcatagggcagcgcattgaaaatatcaagtgtgagcataaatcaacctggcactatgacgaggataacccttacaagacatgggcatatcatggatcctacgaagtgaagccatctggcagcgccagttccatggttaatggcgtcgtgaaattgctcactaagccctgggacgtgatccctatggtcacccaaattgctatgacagataccactccattcgggcagcagagggtttttaaagagaaggtggacacgcggacacccaaagcgaagagaggaaccgcccaaataatggaagtaactgcacgctggctgtggggtttcctaagcaggaacaagaaaccgcgaatctgcacccgggaggaatttacaagaaaggtgaggtctaatgctgccattggcgcagtcttcgtggacgagaaccagtggaactcagccaaagaggctgttgaagatgagcgcttttgggaccttgtgcaccgtgaacgggagctgcacaagcaggggaaatgcgccacgtgtgtctataacatgatgggaaagagagaaaagaaactcggcgagttcggtaaggcgaaagggagtagggcaatctggtacatgtggctgggagcccgctttttggagttcgaagctctgggcttcatgaatgaggatcattggttttcccgagaaaacagcctctctggcgtggagggggagggacttcacaagctgggttacattttacgggacatctcgaaaatatcaggcgggaatatgtatgccgatgacaccgcaggatgggatactagaatcacagaagacgatctgcagaacgaggctaagattaccgaaatcatggagcctgaacatgcccaattggctaaagccattttcaagctcacttaccagaataaggtagttagggtgcagcgcccagccaaaaatggcacagtcatggacgtgatcagcagacgggatcagaggggttccgggcaagtgggaacctatggcctgaatacatttactaacatggaggcgcagctaatacgtcagatggagagtgaaggcattttctctcccagcgagcttgaaacccctaacctggccgagcgagtcctcgactggctggaaaagtacggggttgagcgcttgaaaagaatggctatctccggagatgactgcgtggtaaagccaatcgacgatcggtttgccacggcattaaccgctctgaatgacatgggtaaagtgaggaaggatattccccagtgggagccgtcaaagggctggaacgactggcaacaggtccctttctgtagtcaccactttcatcagctcataatgaaagatgggcgcgaaatcgtggttccctgcagaaatcaggacgagcttgtgggacgggccagggtctctcaaggcgcaggttggagcctgcgagaaacagcctgtctagggaagtcctatgcgcagatgtggcagctgatgtacttccaccgtagagatctccgcttggctgccaacgcaatttgctcagccgtgccagtagactgggttcctactagccggaccacatggtctatccatgctcaccatcaatggatgactaccgaggatatgctgtccgtgtggaatagggtctggattgaagagaacccctggatggaggacaaaacgcacatcagtagctgggaagatgtgccatatcttggaaagagagaggaccagtggtgtggctcgctgataggcctcacagcccgcgcaacctgggctactaatatccaggttgccattaaccaggtgcggaggttaatcgggaatgaaaactacctggactacatgacatccatgaaacgatttaagaatgagtctgatcccgagggagcgttgtggtga

SEQ ID NO: 13208 - RNA, 9879 nt, synthetic construct
  misc_feature 1..9879: note = derived and/or modified CDS sequence (opt3) from DENV-1__KP188567__SS-prME
  source 1..9879: mol_type = other RNA
agcgtgacaatgctgctcatgcttctgcccacagccttggctttccacttaactacgagaggcggggagcctcatatgatcgtctccaagcaggaaagaggaaaatctctgctgtttaagacatcagttggtgtgaacatgtgcacactcattgccatggacctgggcgagctttgtgaagatactatgacctacaaatgcccacggataacagaggccgaaccggacgatgtagactgttggtgcaatgcgaccgatacttgggtgacatatgggacctgtagtcaaacgggagagcaccgccgagacaagcgtagcgtcgctctggcaccccatgtgggcttgggtctcgagactagaaccgaaacatggatgtcctctgagggggcatggaaacagatccagaaggttgaaacttgggccctgaggcaccctggattcaccgtgattgctctgtttctcgcacatgccatcggcacatcgattacccagaagggcatcatattcatcttactgatgcttgtcacgccatcaatggctatgcggtgcgtggggattggaaaccgcgattttgtagagggtttgagcggcgccacttgggttgacgtggtcctggagcacgggagttgtgtgacaaccatggcgaaaaataagcccactctagatatcgaactcctgaaaacagaggtgaccaaccctgcaattcttagaaagctgtgcatcgaagccaaaatatccaatacgaccacagactctaggtgtccaactcaaggagaggctaccttggtcgaggaacaggatgccaacttcgtttgccggcgcacatttgtggaccgaggctggggtaatgggtgtggactcttcggcaagggcagcctgttaacttgcgcaaagtttaaatgcgtaaccaagctggaggggaaaattgtgcagtacgaaaacctcaagtattccgtcatcgtgacagttcacaccggagatcagcatcaagtgggtaatgagactacggaacacggcacaattgctaccatcactccccaggcccctacctcagagatccagcttacagactacggggcgctgaccttggactgtagtccaagaactggactagatttcaacgaaatggtcctgctcacaatgaaagaaaagagctggctggtgcataaacagtggtttcttgacctgccgttgccctggacgtctggcgcctccacctcacaagagacttggaataggcaggatctcctggtaacattcaagaccgcacacgctaagaaacaggaagttgtggtcttaggtagccaagagggggccatgcacacagctctgactggcgccaccgaaattcagacgagtggaaccacaactatatttgcaggccatctaaagtgccggctcaaaatggacaagctgacccttaaagggatgtcttatgtgatgtgtacaggatccttcaagttggagaaggaagtcgccgagactcagcacggtaccgtgctggttcaggtgaaatacgagggcacggatgctccttgcaagatcccattcctcacacaagacgaaaaaggggtaacccagaacggacgtctgattactgcgaatcccatcgtcacagataaggagaaacctgtgaacatagaaaccgagccaccctttggcgagagctatattgttgtgggtgcaggggaaaaggcccttaagctgtcgtggttcaaaaagggatcttccatcggaaaaatgtttgaggctactgcccgcggcgcaagaaggatggccatcttgggggacaccgcttgggatttcggatcaattggtggcctctttacaagtgtcgggaagctgatccatcaggtgttcggaacggcctacggcgtattatttagcggtgtgtcctggaccatgaaaattgggataggcatcctgctaacttggctcggactaaattctcggagcacatcacttagtatgacctgtattgcagttggcatggtcacattgtacctgggggtgatggtgcaggcggactccggatgcgtcatcaactggaagggccgagaactcaagtgtggtagcgggatcttcgttactaacgaggtgcacacctggacggaacaatataaatttcaggctgattctccgaagcgcctgtcagccgcaattggaaaagcctgggaggagggcgtgtgcggtataagaagtgctacaaggttagaaaatatcatgtggaagcagattagcaacgagctgaattacatccttttggaaaacgacatgaaattcaccgtagtcgtgggcgacgttaatgggattctcgcccagggaaagaaaatgatcaagcctcaacccatggagcataagtattcctggaaatcttggggcaaggcaaaaataatcggggctgatattcagaacactacctttatcattgacggaccagatacacctgaatgtcccgacgatcagcgggcctggaatatctgggaggtggaggactacggcttcggtatatttactaccaacatttggctgaagctacgcgattcgcacacacagatgtgcgaccacagactgatgagcgcggccatcaaagattccaaggctgtccatgcagacatggggtattggattgaatcagagaagaatgaaacgtggaaactcgccagggctagtttcatcgaggtgaagacctgtatatggccaaaatctcacactctgtggagcaacggagttcttgaatccgagatggtgatccccaagatttacggcggtcctatctcacaacataattatcgtccaggctacttcacacagaccgccgggccgtggcacttgggaaaactggagttagattttgacctctgcgaaggcactacagtagtcgtggatgagcactgcgggtaccggggacccagcctgcgaaccacgactgtgaccggcaagattatccatgaatggtgttgcagatcttgtacacttcctccactgaggttccgcggtgaggacgggtgctggtatggaatggagatacggcccgtcaaggaaaaagaggaaaacttggttagatccatggtgagtgcaggcagcggtgaggtagactctttttccctcggcattctgtgtgtgtcaatcctaatcgaagaggtcatgaggagtcgctggagccgaaagatgctgatgaccgggactctcgcggtgttcctgcttttgattatgggacagctgacatggaatgatttaatccggctctgcattatggttggcgccaacgctctggaccgtatggggatgggaaccacataccttgccctgatggcaacttttaaaatgagacctatgttcgctgtgggcctactctttaggcgcctgacctcgcgggaggtcttgctgttaacggtgggtctctccctggttgcctctgtggaacttccaagctcactggaggaattgggggatggactcgcaatgggcataatgatgctgaagctactgacagacttccaaccccaccagctttggaccactctcctgagtttgacctttatcagaacatccctgtctttagattatgcctggaaaactatggctatggcgctcagcattgtctccctgttcccgctttgtctgtcaaccacgagccagaagacaacctggttgcctgtactcctgggcagttttgggtgcaagccactaactatgttcctgatcacagagaataaaatttggggaaggaagtcttggcccatcaacgaaggtataatggccgtgggcatcgtttccattcttctcagctcgctgttgaaaaacgacgtgcctttagcagggcccctgatcgctggaggcatgctcattgcctgttacgtcatctcaggttctagtgccgatctgtcccttgagaaggctgcagaggtgagctgggaagaggaagccgagcattctgggaccagccacaatatactggtagaagtgcaggacgatggaactatgaaaattaaggacgaggagcgagatgacacattgaccatcctactgaaagcgacgctcctggctgtctccggcgtttatccaatgtcaatccctgccactctttttgtgtggtacttctggcaaaagaagaaacagcgcagtggcgtgttatgggatacccccagcccaccggaagtcgagcgggcagtgctggacgacgggatttatagaatactccagaggggattgctgggtcgttctcaggttggcgtaggggtgttccaagatggagtctttcatacaatgtggcacgtgacccgcggcgccgttctcatgtaccagggtaagcggctggaaccttcctgggcttcagtgaaaaaggaccttatcagttacgggggaggctggagattccagggcagctggaacacaggggaggaggtccaggtgattgcagtagaacccggcaagaatccaaagaacgtccaaactacccccggtacgtttaagacacctgagggcgaagtgggggccatcgcgctggatttcaaaccaggaacttccggctctcccattgttaatagggagggtaagatcgtggggttgtatggaaacggcgtcgtgaccacatcgggcacctacgttagcgctatagcccaggcaaaagccactcaggaagggaccctacctgagatcgaggacgaagtgtttaagaaacgaaatctgacaattatggatctccacccgggatcaggtaagacgcggcgctatttaccagctatcgtcagagaggccattaagaggaaactgcggactcttatcctggcacccacccgagtggtagcttccgaaatggccgaggcgctcaagggcatgcctataagataccaaacaaccgccgtgaaaagtgaacatactgggcgcgagattgttgacttgatgtgccacgcaacattcaccatgaggctgctctctccagtccgtgtgcccaactataatatgatcatcatggatgaggctcattttacggaccctgccagcattgctgcacggggatacatctccactagagtgggcatgggtgaagccgccgctatattcatgacagcgaccccgcccgggtcagtcgaggcatttccacagtctaacgccgtaattcaggatgaagagagggacatccctgaacgcagctggaatagtggatatgattggattaccgacttccccggcaagactgtgtggtttgttccatccatcaaaagcggcaacgacatagctaattgtctgcgaaagaacgggaagagagtgattcagctttctcggaaaacattcgataccgagtaccaaaagaccaaaaataacgactgggattacgtcgtgactacggacatctcagagatgggagccaacttcagggcagatcgcgttatcgaccctcgtagatgcctaaagcccgtgattctgaaagaaggtccagagcgggtcatcttggccggcccgatgcctgtgaccgtagcttccgcggcccagaggcgcgggcgaattggaagaaatcagaacaaggaaggcgatcagtatatatacatgggtcaacccttaaataacgacgaggatcacgcacattggacagaggctaagatgctgctcgacaatatcaacactccagaagggattatccccgccctgtttgagcctgaacgggagaaaagtgcagccatcgatggcgaatataggcttcgcggagaggctagaaagaccttcgtggagctgatgaggcggggcgacctcccagtttggttgagctacaaagtcgcctcggaagggtttcagtattctgatcgtcgctggtgcttcgacggagagcgaaataaccaggtgctggaagagaatatggacgtggaaatttggacaaaggagggtgagaggaaaaagctaaggccccggtggctggatgcgcgcacctactccgaccctctcgcacttagagaatttaaagagttcgccgctggcaggcggagcgtctcaggggatctgatattagaaatcggaaagttgccgcagcacctgactctccgagcccaaaacgctctggacaatcttgttatgctgcacaacagtgagcagggcggtaaggcatatagacatgccatggaggaactcccagatacgattgagaccttgatgctgttagctctaatcgccgtgctgacagggggcgtaactctctttttcctttctggaaaaggcctggggaagacctccattggattgctgtgtgtgatggcaagctcagcgctcctgtggatggccagtgtcgaaccccactggatcgctgccagcataatccttgagtttttcctcatggtgctgttgattcctgaacccgaccgccagaggacaccacaggataatcaactggcatacgttgtgatcggtttactatttatgattctgaccgtcgctgccaacgagatgggcctccttgagactaccaaaaaggacctggggatcggacatgtagcagtggaaaatcaccaccatgccacgatgttggatgttgacctgcggcctgcttccgcgtggaccctctacgccgtggcaactacagtcataacccccatgatgcgtcacaccattgagaacacaactgctaacatctctctgacggccattgccaatcaggcagctatccttatgggcttagataaaggttggccaataagcaagatggacatcggggtgcctctgctcgccttgggctgctattcccaggtcaacccgctgaccctaacagcggctgtgctgatgctcgttgcccattacgcaattatcggacccggccttcaagccaaggctactagagaagcacagaaaaggaccgccgcggggattatgaagaatccaacagtggatggaatcgtaaccatagacctggaccctgtggtctatgatgctaaattcgagaagcagttgggccagattatgctgctcatcctgtgtacttcacaaatcttacttatgcgcacgacatgggccctgtgcgaatctattaccctcgcaactggtcccctaaccacactgtgggaggggagtccaggaaaattttggaacactaccatcgccgtttcgatggctaatatattccggggcagctacttggccggtgcaggcctggctttctccctcatgaagtctcttgggggaggccgaagagggacaggagcccagggcgagacgctgggtgaaaagtggaaaaggcagttgaaccagctgtcaaagagcgagtttaatacctataaaaagtccgggattatggaagtggaccgcagtgaggcgaaagaaggactcaagcggggcgagactacaaagcacgccgtctctagaggtaccgcaaaattacgttggttcgtggagaggaacctggtaaagcctgaaggcaaagtgatcgatcttgggtgtggacggggcgggtggagctactattgcgctggactgaagaaagttactgaggtgaagggctacacaaaaggtgggcccggacatgaggagccgattccaatggccacctacggctggaatctagtcaagctccactcaggcaaggacgtgtttttcacgcctcccgaaaaatgtgataccctgttgtgcgacatcggggagtccagtccaaaccccacaatagaggaaggacgcactctgcgagtcctcaagatggtggagccttggcttagaggtaatcaattttgtatcaaaattctgaacccgtatatgcccagcgttgtagaaaccttagagcagatgcagaggaagcacggcgggatgctggtgcggaatccattgtctcgcaactccacacatgagatgtactgggtctcatgcggaactggcaatatcgtgagcgcagttaacatgacctcgagaatgctcctgaataggttcacaatggctcaccgaaaacctacctatgaacgggatgtggacctaggtgccgggactcgtcatgtcgccgtggagcccgaagtagcgaaccttgatattatcggacagagaattgagaacatcaagaatgaacacaagtctacgtggcactacgacgaggataacccttataaaacatgggcttaccatggcagttatgaggtgaagccatccggcagcgcatcatccatggttaatggggtcgtgcgcctgctcaccaaaccctgggacgtgatacctatggtcactcaaattgccatgaccgacacaacgccatttggacagcagagggttttcaaggaaaaagtggatacccggactcccagagctaagcgcggtacagcccaaatcatggaggtaaccgcaaagtggctgtggggctttttgtctaggaacaaaaagccgcgaatctgtactcgggaagagttcacaagaaaagtgaggagcaatgccgctattggggcggtctttgtggacgaaaaccagtggaatagtgccaaggaggcagttgaggatgaacgcttctgggacctggtgcaccgtgagcgggaactccataaacagggaaagtgcgctacctgcgtctacaacatgatgggcaagagagagaagaaacttggtgaatttgggaaagccaaaggatccagggcaatatggtacatgtggctgggcgcccgcttcttagagttcgaggctctgggctttatgaatgaagatcactggttcagccgagagaactctttgtcaggggtggaaggagagggtctccataaactgggctatatcctacgggacattagtaagatccctgggggaaatatgtacgccgatgacacagcgggctgggatactagaattaccgaggacgatcttcagaacgaagcaaaaatcacggacataatggagccagaacacgccctgctcgctacctccatctttaagctgacatatcaaaataaggtagttagggtgcagcgccccgccaaaagcggtactgtcatggatgtgatttctagacgggaccagagggggtcgggacaggtgggcacctacggcttgaacacattcactaatatggaggtccaattaatccgtcagatggaatcagaggggatttttagcccttccgagctggaaaccccaaacctcgcaaagaaagttcttgactggctggagaagcacggagctgaacgactaaaacgcatggccatcagtggtgatgactgtgtggtaaagcccatagatgacagattcgctacggccctgacagcactcaacgatatgggcaaggtgcggaaagacattccgcagtgggagccttctaaggggtggaatgattggcagcaagtccccttttgcagccatcacttccatcagttgatcatgaaagacggaagggaaatcgtggttccatgtcgcaaccaggatgagctggtgggcagagcgcgggtctcccagggtgccgggtggtcacttagggagaccgcttgcctgggaaagagttatgcccaaatgtggcagctcatgtactttcaccgacgtgacttaagactggcagctaatgccatttgttctgcagtgcctgccgattgggtacccactagccgcacaacctggtccatacacgcgcatcaccagtggatgactaccgaagacatgttgtcagtttggaaccgggtgtggatcgaggaaaatccatggatggaggacaaaacacatgtcagctcttgggaagaggtgccctatctgggcaagagggaggatcaatggtgcggctccctcattgggcttacggctagagccacctgggcaactaacatccaggttgccattaatcaggtgcgccggctgatcggaaacgaaaattacctagactacatgacaagtatgaagaggttcaaaaacgagagcgatcctgaaggtgctctgtggtga

SEQ ID NO: 13209 - RNA, 9879 nt, synthetic construct
  misc_feature 1..9879: note = derived and/or modified CDS sequence (opt3) from DENV-1__KP188568__SS-prME
  source 1..9879: mol_type = other RNA
agcgtgaccatgctgctcatgcttctgcccacagccttggctttccacttaactacgagaggcggggagcctcatatgatcgtctccaagcaagaaagaggaaaatctctgttatttaagacctcagttggtgtgaacatgtgcacactcattgcaatggacctgggcgagctttgtgaagatactatgacctacaaatgcccacggataacagaggccgaaccggacgatgtagactgttggtgcaatgcgaccgatacttgggtgacatatgggacctgtagtcaaacgggagagcaccgccgagacaagcgtagcgtcgctctggcaccacatgtgggcttgggtctcgagactagaaccgaaacatggatgtcctctgagggggcatggaaacagatccagaaggttgaaacttgggccctgaggcaccctggattcaccgtgattgctctgtttctcgcacatgccatcggcacatcgattacccagaagggcatcatattcatcttactgatgcttgtcacgccatcaatggctatgcggtgcgtggggattggaaaccgcgattttgtagagggtttgagcggcgccacttgggttgacgtggtcctggagcacgggagttgtgtgacaaccatggcgaaaaataagcccactttggatatcgaactcctgaaaacagaggtgaccaaccctgcagtccttagaaagctgtgcattgaagccaaaatctccaatacgaccacagactctaggtgtccaactcaaggagaggctaccttggttgaggaacaagatgccaacttcgtgtgccggcgcacatttgtagaccgaggctggggtaatgggtgtggactcttcggcaagggcagcctgttaacttgcgcaaagtttaaatgcgtgaccaagctggaggggaaaatagtccagtacgaaaacctcaagtattccgtgattgttacagtgcacaccggagatcagcatcaagtcggtaatgagactacggaacacggcacaatcgctaccattactccccaggcccctacctcagagatccagcttacagactacggggcgctgaccttggactgtagtccaagaactggactggatttcaacgaaatggtgctgctcacaatgaaagaaaagagctggctggtacataaacagtggtttcttgacctgccgttgccctggacgtctggcgcctccacctcacaagagacttggaataggcaggatctcctggttacattcaagaccgcacacgctaagaaacaggaagtggtcgtgttaggtagccaagagggggccatgcacacagctctgactggcgccaccgaaatccagacgagtggaaccacaactatttttgcaggccatctaaagtgccggctcaaaatggacaagctgacccttaaagggatgtcttatgtcatgtgtacaggatccttcaagttggagaaggaagtggccgagactcagcacggtaccgttctggtgcaggtaaaatacgagggcacggatgctccttgcaagataccattcctcacacaagacgaaaaaggggtcacccagaacggacgtctgatcactgcgaatcccattgtgacagataaggagaaacctgttaacatcgaaaccgagccaccctttggcgagagctatatagtggtcggtgcaggggaaaaggcccttaagctgtcgtggttcaaaaagggatcttccattggaaaaatgtttgaggctactgcccgcggcgcaagaaggatggccatcttgggggacaccgcttgggatttcggatcaatcggtggcctctttacaagtgtggggaagctgattcatcaggtattcggaacggcctacggcgtgttatttagcggtgtttcctggaccatgaaaatcgggattggcatactgctaacttggctcggactaaattctcggagcacatcacttagtatgacctgtatcgcagtcggcatggtgacattgtacctgggggtgatggtccaggcggactccggatgcgttattaactggaagggccgagaactcaagtgtggtagcgggatcttcgtgactaacgaggtgcacacctggacggaacaatataaatttcaggctgattctccgaagcgcctgtcagccgcaatcggaaaagcctgggaggagggcgtatgcggtattagaagtgctacaaggttagaaaatataatgtggaagcagatcagcaacgagctgaatcatattcttttggaaaacgacatgaaattcaccgtcgtggttggcgacgtgaatgggatcctcgcccagggaaagaaaatgattcggcctcaacccatggagcacaagtactcctggaagtcttggggcaaagcaaagatcataggggctgatatccagaacactacctttattatcgacggaccagatacacctgaatgtcccgacgatcagcgcgcctggaatatttgggaggtcgaggactatggcttcggtatctttactaccaacatatggctgaaactaagagattcgcacacacagatgtgcgaccataggctgatgagcgcggccattaaggattccaaagctgtgcacgcagacatggggtactggatcgaatcagagaagaatgaaacgtggaagctcgcccgtgctagtttcattgaggttaaaacctgtatctggccaaagtctcatactctgtggagcaacggagtgcttgaatccgagatggtaatacccaaaatctatggcggtcctatttcacaacacaattaccggccaggctatttcacacagaccgccgggccgtggcacttgggaaagctggagttagattttgacctctgcgaaggcactacagtcgtggtggatgagcattgcgggtaccgaggacccagcctgagaaccacgactgtcaccggcaaaatcattcacgaatggtgttgcaggtcttgtacacttcctccactgcgcttccggggtgaggacgggtgctggtacggaatggagatcagacccgttaaggaaaaggaggaaaacttggtgaggtccatggtaagtgcaggcagcggtgagatggactctttttccctcggcatactgtgtgtgtcaattctaatcgaagaggtcatgcgcagtcgatggagccggaaaatgctgatgaccgggactctcgcggtgttctttctgcttatcatgggacagttgacatggaatgatctgattcgtttatgcatcatggttggcgccaacgcttcggacagaatggggatgggaaccacatatctcgccctgatggcaactttcaagatgaggcctatgtttgctgtgggccttctgttccgccggctaacctccagagaggtcctcctgttgacggtgggtctgtctttagttgccagcgtggaactcccaaattcactggaggaacttggggatggactggcaatgggcattatgatgttgaaactcctgacagactttcaaccccatcagctatggaccactctgcttagtctcaccttcataaggacatccctgtctttggattacgcctggaagactatggctatggcgctgagcatcgtctccttatttccgctctgtctgtcaaccacgagccagaaaacaacctggcttcctgtactgttgggcagtttcgggtgcaagccactcactatgtttctgattacagagaacaagatctggggacgaaaatcttggcccattaacgaaggtatcatggccgtgggcatagtttccatcctactgagctcgcttctcaagaatgacgtgcctctggcagggcccttgattgctggaggcatgttaatcgcctgttatgtcatttcaggttctagtgccgatctgtccctcgagaaagctgcagaggtgagctgggaagaggaagccgagcactctgggaccagccataacatcctggtagaagtgcaggacgatggaactatgaagataaaagacgaggagcgcgatgacacacttaccattctgttgaaggcgacgctactggctgtctccggcgtttacccaatgtcaatccctgccactctcttcgtgtggtatttctggcagaaaaagaagcagcggagtggcgtgctgtgggatacccccagcccaccggaagtcgagagagcagtgcttgacgacgggatctacaggattttacagcgtggactgctcggtcgctctcaggttggcgtaggggtgtttcaagatggagtcttccacacaatgtggcacgtgacccggggcgccgttttgatgtatcagggtaaaagactggaaccttcctgggcttcagtgaagaaagacctcataagttacgggggaggctggaggtttcagggcagctggaatacaggggaggaggtccaggtgatcgcagtagaacccggaaagaaccccaaaaatgtccaaactacccccggtacgttcaagacacctgagggcgaagtgggggccattgcgctggattttaagccaggaacttccggctctcccatcgttaaccgagagggtaaaattgtggggctttacggaaatggcgtcgtgaccacatcgggcacctatgttagcgctatcgcccaggcaaaggccactcaggaagggcctctgccggagatagaggacgaagtgttcaaaaagcggaacttgaccatcatggatctacatccaggatcaggtaaaacacgcagatacctgccctccattgtcagggaggctatcaagcggaagctccgaacgttaattctggcccctactagagtggtagcaagtgaaatggctgaggcccttaaaggcatgccaatccgctatcaaaccacagcggtgaagtctgaacacaccgggagggagatagttgacctgatgtgccatgccacttttacaatgcgtctcttgagccccgtccgggtgcctaattacaacatgattatcatggatgaggcacacttcaccgacccggcttccatcgccgctagaggatatatttcaacgagggtgggcatgggtgaagcagccgccatctttatgactgctacacccccagggtctgtcgaggcgttccctcagagcaatgcagccatacaggatgaggaacgcgacattcccgaacgaagttggaacaccggatacgattggatcaccgactttccaggcaaaactgtatggttcgtgccttccattaagagcggcaatgacatcgctaactgtctgaggaaaaatgggaagcgggttatacagctctctaggaagacattcgataccgagtatcagaaaacaaagaacaacgactgggattacgtggtcactacggacatttcagagatgggagccaattttcgcgcagatcgtgtgatcgaccccagacggtgcctgaaaccagttatccttaaggaaggtccggagagggtgattctagccggccctatgcccgtcaccgtggcttccgcggcccagcgccgagggagaatcggacggaaccagaataaagaaggcgatcagtacatttatatgggtcaaccactgaacaatgacgaggatcatgcacactggacagaggctaagatgttgttagacaacataaatactcccgaagggatcattcctgccctgttcgagccagaaagggagaagagtgcagccatcgatggcgaataccgcctcagaggagaggctaggaaaacctttgtagagctgatgcggcgtggcgaccttcccgtgtggctgagctataaggttgcctcggaagggttccagtactctgatcgccgatggtgctttgacggagagagaaacaatcaggtcctcgaagagaacatggacgtggaaatctggacaaaagagggtgagaggaagaaattgcggcctcgctggctggatgcgagaacctattccgacccgctagcactgagggagttcaaggagtttgccgctggccggcgaagcgtgtcaggggatctcattcttgaaataggaaaactgccacagcacttaactttgagagcccaaaatgctctggacaacctcgtcatgctgcataatagtgagcagggcggtaaggcataccgccacgccatggaggaacttcccgatacgatcgagaccctgatgctcttggctctgattgccgttttaacagggggcgtgactctattctttctgtctggaaagggcctcgggaaaacctccatcggacttctgtgtgtaatggcaagctcagcgttgctgtgggtggccagtgtcgaacctcattggattgctgccagcatcatactcgagttctttctgatggtgcttctcatccccgaaccagacaggcagcggacacctcaggataaccaactggcatatgttgtgattggtttgctgttcatgatcttaaccgtcgctgccaatgagatgggcctactggagactacaaagaaagacctcgggattggacacgtagcagtggaaaaccaccatcacgccacgatgcttgatgttgacctgcgtcccgcttccgcgtggaccttgtacgccgtggcaactacagtcatcaccccaatgatgagacataccatagagaacacaactgctaatatttctctgacggccatcgccaaccaggcagctattctcatgggcctggataagggttggcctatcagcaaaatggacataggggtgccgcttttagccctgggctgctactcccaggtcaatcccctcaccttgacagcggctgtgctgatgctagttgcccactatgcaatcattggaccaggcctgcaagccaaggctactagggaagcacagaagcgcaccgccgcggggatcatgaaaaaccctacagtggatggaattgtaaccatcgacctcgaccccgtggtctacgatgctaagtttgagaaacagcttggccagataatgctgttgattctgtgtacttcacaaatcctcctgatgcggacgacatgggccttatgcgaatctatcacccttgcaactggtccactgaccacactctgggaggggagtcctggaaagttctggaatactaccattgccgtttcgatggctaacatcttccgaggcagctatctagccggtgcaggcctggctttttccgtgatgaaatctctagggggcggcagaagggggacaggagcccagggcgagacgctgggtgaaaagtggaagcgccagctcaatcagctttcaaaaagcgagttcaacacctacaagaaatccgggataatggaagtcgaccggagtgaggcgaaggaaggactgaaaagaggcgagactacaaagcatgccgtgtctcgtggtaccgcaaagttgaggtggtttgtagagcggaatctggtgaaacccgaaggcaaggttattgatctcgggtgtggacgcggcgggtggagctattactgcgctggactgaaaaaggtgactgaggtcaaaggctatacaaagggtgggccgggacacgaggaaccaatccctatggccacctacggctggaacctagtgaaacttcactcaggcaaggacgtcttctttacgcccccagaaaagtgtgataccctgctatgcgacattggggagtccagtcccaatcctacaatcgaggaaggacgaactctcagagtgctgaaaatggttgagccgtggttgaggggtaaccaattctgtataaagatcctgaatccctacatgccaagcgtagtggaaaccctcgagcagatgcagcggaaacatggcgggatgcttgtccgcaaccctctgtctagaaattccacacacgagatgtattgggtgtcatgcggaactggcaacattgttagcgcagtgaatatgacctcgaggatgttactgaaccgatttacaatggctcatcggaagcccacctacgaacgtgatgtcgacttgggtgccgggactagacacgtggccgtagagcctgaagtggcgaacctcgatatcattggacagcgcatcgagaatattaaaaacgaacacaagtctacgtggcattatgacgaggataatccatacaagacatgggcttatcacggcagttacgaggttaaaccctccggcagcgcatcatccatggtcaacggggtggtgaggctgctaaccaagccttgggacgtcatcccaatggttactcaaatagccatgaccgacacaacgcccttcggacagcagcgggtgtttaaagaaaaggtagataccagaactccgcgcgctaaaaggggtacagcccaaattatggaggtgaccgcaaagtggctttggggcttcctgtctcgaaataagaaacctcggatctgtactagagaagagtttacaaggaaggtccgcagcaacgccgctatcggggcggtgttcgttgacgaaaatcagtggaacagtgccaaagaggcagtggaggatgaacgtttttgggacctcgtccatcgggagagagaactgcacaagcagggaaaatgcgctacctgcgtgtataatatgatgggcaagagggagaagaaattgggtgagttcgggaaggccaaaggatcccgcgcaatttggtacatgtggctgggcgcccgattcctcgagtttgaggctcttggcttcatgaacgaagatcattggtttagccgggaaaattctctgtcaggggtagaaggagagggtttacacaagctgggctacatattgagagacatcagtaaaattccagggggaaacatgtatgccgatgacacagcgggctgggatactaggatcaccgaggacgatctccagaatgaagcaaagattacggacatcatggagcccgaacacgccctgctagctacctccatattcaaacttacataccaaaacaaggttgtgcgcgtccagagacctgccaagagcggtactgtgatggatgtgatctctcggagggaccagcgtgggtcgggacaggtcggcacctatggcctgaatacatttactaacatggaggttcaactcattcgacagatggaatcagaggggatcttcagcccatccgagctggaaacccccaacttggccaaaaaggtgttagactggctggagaaacatggagctgaacgcctcaagagaatggccattagtggtgatgactgtgtagtgaaaccgatcgatgaccggtttgctacggcccttacagcactgaatgatatgggcaaggtcaggaaggacatacctcagtgggagccctctaaagggtggaacgattggcagcaagtgccattctgcagccaccattttcaccagctaattatgaaggacggacgcgaaatcgttgtgccttgtagaaatcaggatgagctggtcggccgggcgagggtgtcccagggtgccgggtggtcactccgagagaccgcttgcttgggaaaaagttacgcccaaatgtggcagctgatgtatttccaccgtagagaccttcgcctggcagctaacgccatctgttctgcagtacccgttgattgggtgccaactagccggacaacctggtccattcatgcccaccatcagtggatgactaccgaagacatgctctcagtctggaatagggtgtggatagaggaaaacccctggatggaggacaagacacacgttagctcttgggaagaggtgccttacttaggcaaaagagaggatcaatggtgcggctccctgatcgggttgacggcgcgcgctacctgggccactaatattcaggtcgcaatcaaccaggtgcggaggctgattggaaatgaaaactatctcgactacatgacaagtatgaagcgatttaagaatgagagcgatccagaaggtgccctttggtga

SEQ ID NO: 13210 - RNA, 9879 nt, synthetic construct
  misc_feature 1..9879: note = derived and/or modified CDS sequence (opt3) from DENV-1__KF971870__SS-prME
  source 1..9879: mol_type = other RNA
agcgtgacaatgctgctcatgcttatgcccacagcactggctttccacttgactacgagaggaggggaacctcatatgatggtctccaagcaggaaaggggaaaatctttactgtttaagacctcagccggtgttaacatgtgcacactaatcgccatggacctcggagaactgtgtgaagatactatgacctacaaatgcccacggattacagaggcggaaccggacgatgtggactgttggtgcaatgctaccgatacttgggtaacatatgggacctgtagtcaaacgggagagcaccgccgagacaagcgtagcgtggcccttgcaccccatgtcggcctgggtttggagactagaaccgaaacatggatgtcctctgagggggcctggaaacagatacagagggtggaaacttgggctctccggcaccctggattcaccgttatcgcactgtttctggcccatgctattggcacatcgatcacccagaagggcattatcttcatactcttaatgctggtgacgccatcaatggccatgcgctgcgtcgggatcggaagcagagattttgtggagggtcttagtggcgcgacttgggtagacgttgtgttggagcacgggtcctgtgtcacaaccatggcaaaggataaacccactctggacattgaactactcaagacagaggtgaccaaccctgccgtgctgaggaaactttgcatcgaagctaagatttctaatacgaccacagatagccggtgtccaactcaaggagaggccaccctggtcgaagaacaggacgcaaacttcgtttgccgccgaacatttgtggatagaggctggggtaatgggtgtggattgttcggcaaaggctccctcatcacttgcgctaagtttaagtgcgtaaccaaactggaggggaagatagtgcagtacgaaaacttaaaatattcagtcattgtgacagttcacaccggagaccagcatcaagtgggtaatgagagtactgaacacggcacgacagccaccatcactccccaggcgcctaccacagagattcagctgaccgactacggggccctcactcttgattgtagcccaaggacaggactggacttcaacgaaatggtcttgctaacgatgaaggagaaatcttggctggtgcataagcagtggtttctcgatctgccgcttccctggacctccggcgcatcaactagccaagagacatggaatcggcaggacctgttggtaaccttcaaaacagctcacgccaagaagcaggaagttgtggtcctcggtagtcaagagggggctatgcacactgccctgaccggcgcaacggaaatccagacctctggaacaactaccatctttgccggccatttaaaatgccgtctgaagatggataaactaacactcaaggggatgtcctatgtgatgtgtactggcagcttcaaactggagaaggaagtcgctgagacccagcacggtacggtgcttgttcagattaagtacgagggcacagacgcgccttgcaaaataccattctcgacccaagatgaaaagggggtgactcagaacggacgcttgatcacagcaaatcccattgtaaccgacaaagagaagcctgtcaacatcgaagccgagccaccctttggcgagtcttatatagtgattggtgctggggaaaaagccctgaagctctcctggttcaagaaaggctcaagtatcggaaagatgtttgaggcaactgccagaggcgctaggcggatggccatcctgggggataccgcatgggacttcggaagcattggtggcgtttttacatccgtggggaaacttgtccatcagatcttcggaacggcgtacggcgtgctgttttctggtgtaagctggaccatgaagattgggataggcgtgttgctcacttggctgggattaaattcacgaagtacatccctgagcatgacctgtatcgctgttggcctagtcacactctacctgggggtgatggtgcaggccgattctggatgcgtcattaactggaaaggccgcgaacttaagtgtggttcagggatcttcgttactaatgaggtgcacacctggacggaacaatataagtttcaggcagacagtccgaaaagattgagcgccgctatcggaaaggcctgggaggagggcgtgtgcggtattaggtccgcaacacggctggaaaacataatgtggaaacagatctctaacgagctcaatcatattctgttagaaaacgacatgaagttcaccgtagtcgtgggcgatgttgctgggatcctggcccagggcaaaaagatgattcgccctcaacccatggagtacaaatattcgtggaaaagctggggcaaggcgaagatcataggggccgacgtgcagaatactacctttatcattgatggaccaaacacacctgaatgtcccgacgatcagagagcttggaatatctgggaggtcgaggactacggcttcggtatttttactaccaacatctggcttaagttgagggattcctatacacaggtgtgcgaccaccgtctcatgtcaagtgcaataaaagattctaaggccgttcacgctgacatggggtactggattgaaagcgagaaaaatgatacgtggaagctggcccgggcatccttcatcgaagtgaagacctgtatttggccaaaatcacatactctatggagcaacggagtactggagtctgaaatgatcatacccaagatctatggcggtcctatttcccaacacaattaccgaccaggctacttcacacagaccgcggggccgtggcatctcggaaaactggagcttgactttgatttgtgcgagggcactacagtcgtggtggacgaacactgcgggaacagaggacccagtctgaggaccacgactgtcaccggcaagatcattcacgagtggtgttgccgcagctgtacattacctccactccggttcagaggtgaagacgggtgctggtatggaatggagatcaggcccgttaaagagaaggaagagaatctggtgaagtctatggtatccgccggctcaggtgaagtggatagttttagccttggcctgttgtgtatatcgattatgatcgaggaagtcatgcgctcccgatggtctcggaaaatgctcatgatcgggaccctggctgtgttctttctactgattatgggacagctcacttggaacgacctgatccgtctttgcattatggttggcgccaatgcaagcgatagaatggggatgggaacaacctacttggctctgatggccacattcaagatgaggcctatgtttgcagtgggcttactcttccgccggctgacttcaagagaggtccttctgctaaccataggtctcagtctggtggcctccgctgagttgccaaactctctggaagagttaggggacggactcgcgatgggcatcatgattctgaaacttctgacggattttcaaagccatcagttgtgggccacactcctgtccctaaccttcatcaagactaccttttcactgcactatgcatggaaaacaatggctatggttcttagcattgtgagtctcttccccctgtgtttgtctactacctcccagaagacgacatggctgccggtcttactcggcagcctggggtgcaagcctcttaccatgtttctgatcgccgaaaataaaatatggggaaggaagtcgtggccattgaacgagggtatcatggccgtaggcattgtgtcaatcctcctgtctagtctactgaaaaacgacgttccccttgctgggcctctcattgcaggaggcatgctgatcgcctgttacgtgatatccggtagctctgcggatttgagcttagaaaaggctgccgaggtctcctgggaggaagaggcagaacattcaggggccagtcacaatattctggtggaggtacaggacgatggaactatgaaaatcaaggacgaagaacgagatgacacactcaccatcctgcttaaagctactctgttggcagtgagcggcgtcttccccctatctattccagccacactgttcgtttggtatttttggcaaaagaagaaacagcgctccggcgtgctctgggataccccttcacccccagaggtggaacgggcggtcctggacgacgggatatacagaatcatgcagaggggacttttaggtcgtagtcaggtgggcgttggggtattccaagagaacgtgtttcatacgatgtggcacgtcactcgcggagctgtgctgatgtatcagggcaagcggctcgaaccgagctgggcctccgttaaaaaggatttgatttcttacggtgggggatggagactgcagggctcgtggaataccggcgaggaggtgcaggtcatcgcagtggaacctgggaaaaaccccaagaatgtacaaacagccccaggaaccttcaagacacccgagggtgaagtcggcgctattgccctcgactttaaacctgggactagcggatcaccaatcgtgaacagggagggcaagatagttggtctgtacgggaatggagtggtcaccacgtccggcacatatgtgagtgcaatcgctcaggccaaagcgtctcaggaaggcccccttcctgagattgaggatgaagttttccgaaagcggaacctgactatcatggacttgcacccggggagcggaaaaacccgcagatacctaccagccattgtgagggaggcaatcaagcggaagctgcgaacactcatattagctcccaccagagtcgtggcctccgaaatggctgaggcactgaaaggtatgcctattcgctatcaaactaccgccgtaaagtcagaacatacaggcaaagagatcgtggatcttatgtgccacgccacgtttactatgaggctgctctctccagttcgtgtccccaattacaacatgatcattatggacgaggctcatttcaccgatcctagcagtatcgcggcacgggggtatatatccacaagagtgggaatgggcgaagccgctgccatttttatgaccgcaactccgcccggtagcgtggaggccttcccacagtctaatgctgtcatccaggacgaagagagggatattcctgaacgctcatggaactccgggtacgagtggatcacagactttcccggaaagaccgtatggttcgtgccaagtataaaaagcggcaatgatattgcgaactgtttgcgaaagaatggcaagagagttatccagctgtcgcggaaaacgttcgacactgagtatcaaaagaccaaaaacaacgactgggattacgtggtcaccaccgacatctctgaaatgggggccaattttagggcagatcgcgtgattgaccctcgtagatgcctcaagcccgttatcctgaaagatggaccagagcgggtgattcttgctggtccgatgcctgtcactgtggcctccgcagcccagaggcgcggccgaatagggagaaaccacaataaggaaggagaccagtacatctatatgggccagcccctaaacaatgatgaggaccatgctcactggacagaggccaagatgctgttggataacattaataccccagaaggtatcatccccgcgttattcgagcctgaacgggagaaaagcgcagccattgacggggaatacaggctgcgcggcgaggctagaaagacatttgtagagctcatgaggcggggagatctgccagtgtggctttcatataaagttgccagtgaaggcttccaatactctgaccgtcgctggtgctttgatggggagcgaaacaatcaggtcctggaagagaacatggacgtggaaatatggactaaggagggagagagagaaaaactcaggccccggtggttgggtgctcgcacgtattccgaccctctggcactaagagatttcaaggagtttgccgctggcaggcggagcgtgtcaggggacctgatcctcgaaattggaaaacttccgcagcacctgacccagcgagcccaaaatgcattagataacttggtcatgctgcataatagtcagcagggcggtagagcgtacacacacgccatggaggaactcccagacactatcgagaccctgatgcttctggctctcattgccgttttgacagggggcgtgaccctgttctttttaagcggacgcggcctagggaagacttccatcggactgctctgtgtaatggcatctagcgtgcttctgtggatggcttccgtcgagccccattggatagccgcatcaatcattttggagttctttctgatggtgctcctgatccctgagcccgataggcagcggacgccacaagacaaccagcttgcctatgttgtgattggtctcctgttcatgatcttgaccgtcgctgcgaatgaaatgggcctgttagagacaactaagaaagatctagggataggacacgtagccgtggagaaccaccatcacgcagctatgctggacgttgatctccatcctgcctctgcctggaccctttacgcagtggctacaaccattatcactcccatgatgcgtcacacaattgaaaacacgaccgccaatatcagtctgactgcgatagctaaccaggccgcaatcttgatgggcctggacaagggttggccaatttcgaaaatggatatcggggtccctctcctggcccttggctgctacagccaagtgaatccgttaacactgaccgctgcagtcctcatgttggtggcccattatgcgattatcggacccggcctgcaggctaaggccaccagagaggcacagaaaaggacagccgctgggataatgaagaacccaactgttgacggaattgtggccatcgatctagaccctgtagtgtacgacgcaaagtttgaaaaacagctgggccaaatcatgctccttattctgtgtacgtcccagatcttgctgatgcgcaccacatgggctctctgcgagtctataactctggccaccggtcccttaacaaccctttgggaagggtcaccaggaaagttctggaatactacgattgcggtcagcatggccaacatcttccggggctcctatctggcaggagctggcctcgcctttagtctaatgaaatctctagggggtggccgaagagggacaggagcacagggcgagaccttgggtgagaagtggaaaaggcgcctgaatcagctcagcaagtcagagttcaacacttacaagcggtccgggattatggaggttgatagaagtgaagctaaagagggacttaagcgtggcgaaaccacaaaacacgccgtgagcaggggtactgccaagctgcggtggtttgtcgagcgcaatttggtgaaacctgagggcaaggtaatcgacctggggtgtggacgaggcgggtggtcttattactgcgcgggactcaagaaagtgaccgaagttaagggctatacaaaaggtgggcccggacacgaggaaccgataccaatggctacgtacggctggaacttagtgaagctgcattccggcaaagatgtcttctttatccctcccgagaagtgtgacacccttctgtgcgatattggggaatcaagcccaaatcccactatcgaggagggaagaacactaagggtgctcaaaatggtcgaaccttggctgcggggtaaccaattctgtattaagatcttgaatccgtacatgccctcggtggttgagaccctggaacagatgcagcgcaagcacggcgggatgctcgtaagaaacccactttctaggaatagtactcatgagatgtattgggtgtcctgcggaacaggcaacattgtcagcgcagtgaatatgacctcacgaatgctgttaaaccggtttacgatggcccaccgtaaacctacctacgagagagacgttgatctgggtgctgggacacgccacgtggccgtcgaacccgaggtggcaaacttggacatcataggacagaggattgaaaatatcaagcatgagcacaaatccacttggcattatgatgaagacaacccttacaagacctgggcctatcacggctcttacgaggtaaaaccaagcggcagtgcttccagcatggtgaatggggttgtcaagctcctgacaaagccctgggatgtgatccctatggtgactcaaattgcgatgaccgacacaaccccattcggacagcagcgggtctttaaagagaaggttgacactagaacgcccaaagccaagcgcggtacagcacaaataatggaagtgaccgctaggtggctatggggcttcctttctcgaaacaaaaagccgcggatctgtactagagaggaatttaccaggaaggtacgctcaaatgccgcaattggggccgtgttcatcgatgagaaccagtggaatagtgctaaagaagccgtcgaggacgagcgtttttgggatctggtgcatcgggaaagagagctccacaagcagggaaaatgcgcgacatgcgtttataacatgatgggcaagagggagaaaaagctgggtgagttcgggaaggcaaaaggatcccgcgccatttggtacatgtggttgggcgctcgattcctggaatttgaggccctcggcttcatgaatgaggaccactggtttagccgggaaaactctctttcgggggtggagggagaaggtctgcataagttaggctacatcctgagagatatatcaaaaatccctgggggaaatatgtatgcagacgatacggctggctgggacaccaggattactgaggatgacttgcagaacgaggccaagatcacagatattatggaaccagagcacgctctcctggccaaagcaatcttcaagctaacctaccaaaataaagtcgtgcgcgtacagagacccgcgaagaacggtactgttatggacgtgataagccggagggatcagcgtgggtccggacaggtcggcacatatggccttaatacctttacaaacatggaagcccaactgattcgacagatggagagtgaagggatcttctctcctagcgagctcgagactccaaacctggctgaacgcgtgttggactggttaggaaagtacggtgtggagagactgaaacggatggccatctccggcgacgattgtgtcgttaagcccattgacgataggtttgcaaccgctctcacggcccttaatgacatggggaaagtgcgcaaggatataccgcagtgggaaccttcaaaaggatggaacgactggcagcaagtacccttctgcagtcatcactttcaccagctgatcatgaaggatggcagagagattgtggtcccatgtcggaatcaggacgagctggtgggtagggcacgagtttctcagggggccggatggagcctgcgtgagaccgcgtgcctcggcaagtcctatgctcaaatgtggcagttgatgtacttccatagacgcgatctgcggcttgccgcaaacgccatctgttcagctgtgcctgtcgactgggtgcccacaagcaggactacctggtctattcacgcccatcaccagtggatgacaactgaggatatgctgtccgtatggaatagagtttggatcgaagagaacccatggatggaagacaaaacccatataagtaattgggaggacgtgccctatctcggcaagcgcgaagatcaatggtgcgggagcttaatcggactgacggcacgggctacatgggccaccaacattcaggtcgcgatcaatcaggtgaggcgattgattggtaacgagaattacctggactacatgacttcgatgaaaagatttaagaacgagtccgatcctgaaggcgctctctggtga

SEQ ID NO: 13211 - RNA, 9879 nt, synthetic construct
  misc_feature 1..9879: note = derived and/or modified CDS sequence (opt3) from DENV-1__KF971871__SS-prME
  source 1..9879: mol_type = other RNA
agcgtgacaatgctgctcatgcttatgcccacagcactggctttccacttgactacgagaggaggggagcctcatatgatggtctccaagcaggaaaggggaaaatctttactgtttaagacatcagccggtgttaacatgtgcacactgatcgccatggacctcggcgagctgtgtgaagatactatgacctacaaatgcccacggattacagaggcggaaccggacgatgtggactgttggtgcaatgctaccgatacttgggtaacatatgggacctgtagtcaaacgggagagcaccgccgagacaagcgtagcgtggcccttgcaccccatgtcggcctgggtttggagactagaaccgaaacatggatgtcctctgagggggcctggaaacagatacagagggtggaaacttgggctctccggcaccctggattcaccgttatcgcactgtttctggcccatgctattggcacatcgatcacccagaagggcattatcttcatactcttaatgctggtgacgccatcaatggccatgcgctgcgtcgggatcggaagcagagattttgtggagggtcttagtggcgcgacttgggtagacgttgtgttggagcacgggtcctgtgtcacaaccatggcaaaggataaacccactctggacattgaactactcaagacagaggtgaccaaccctgccgtgctgaggaaactttgcatcgaagctaagatttctaatacgaccacagatagccggtgtccaactcaaggagaggccaccctggtcgaagaacaggacgcaaacttcgtttgccgccgaacatttgtggatagaggctggggtaatgggtgtggattgttcggcaaaggctccctcatcacttgcgctaagtttaagtgcgtaaccaaactggaggggaagatagtgcagtacgaaaacttaaaatattcagtcattgtgacagttcacaccggagaccagcatcaagtgggtaatgagagtactgaacacggcacgacagccaccatcactccccaggcgcctaccacagagattcagctgaccgactacggggccctcactcttgattgtagcccaaggacaggactggacttcaacgaaatggtcttgctaacgatgaaggagaaatcttggctggtgcataagcagtggtttctcgatctgccgcttccctggacctccggcgcatcaactagccaagagacatggaatcggcaggacctgttggtaaccttcaaaacagctcacgccaagaagcaggaagttgtggtcctcggtagtcaagagggggctatgcacactgccctgaccggcgcaacggaaatccagacctctggaacaactaccatctttgccggccatttaaaatgccgtctgaagatggataaactaacactcaaggggatgtcctatgtgatgtgtactggatcgttcaaactggagaaggaagtcgctgagacccagcacggtacggtgcttgttcagattaagtacgagggcacagacgcgccttgcaaaataccattctcgacccaagatgaaaagggggtgactcagaacggacgcttgatcacagcaaatcccattgtaaccgacaaagagaagcctgtcaacatcgaagccgagccaccctttggcgagtcttatatagtgattggtgctggggaaaaagccctgaagctctcctggttcaagaaaggctcaagtatcggaaagatgtttgaggcaactgccagaggcgctaggcggatggccatcctgggggataccgcatgggacttcggaagcattggtggcgtttttacatccgtggggaaacttgtccatcagatcttcggaacggcgtacggcgtgctgttttctggtgtaagctggaccatgaagattgggataggcgtgttgctcacttggctgggattaaattcacgaagtacatccctgagcatgacctgtatcgctgttggcctagtcacactctacctgggggtgatggtgcaggccgattctggatgcgtcattaactggaaaggccgcgaacttaagtgtggttcagggatcttcgttactaatgaggtgcacacctggacggaacaatataagtttcaggcagacagtccgaaaagattgagcgccgctatcggaaaggcctgggaggagggcgtgtgcggtattaggtccgcaacacggctggaaaacataatgtggaaacagatctctaacgagctcaatcatattctgttagaaaacgacatgaagttcaccgtagtcgtgggcgatgttgctgggatcctggcccagggcaagaagatgattcgccctcaacccatggagtacaaatattcgtggaaaagctggggcaaggcgaagatcataggggccgacgtgcagaatactacctttatcattgatggaccaaacacacctgaatgtcccgacgatcagagagcttggaatatctgggaggtcgaggactacggcttcggtatttttactaccaacatctggcttaagttgagggattcctatacacaggtgtgcgaccaccgtctcatgtcagcagccataaaagatagtaaggctgttcacgccgacatggggtactggattgaatctgagaaaaatgatacgtggaagctggcacgggcgagcttcatcgaagtgaagacctgtatttggccaaaatcccatactctatggtcaaacggagtactggagagcgaaatgatcatacccaagatctatggcggtcctatttctcaacacaattaccgaccaggctacttcacacagaccgccgggccgtggcatctcggaaaactggagcttgactttgatttgtgcgagggcactacagtcgtggtggacgaacactgcgggaacagaggaccctccctgaggaccacgactgtcaccggcaagatcattcacgagtggtgttgccgcagttgtacattacctccactccggttcagaggtgaagacgggtgctggtatggaatggagatcaggcccgttaaagagaaggaagagaatctggtgaagtccatggtatctgctggctccggtgaagtggattcatttagtcttggcctgttgtgtataagcattatgatcgaggaagtcatgcgctcgcgatggtcccggaaaatgctcatgatcgggaccctggccgtgttctttctactgattatgggacagctcacttggaacgacctgatccgtctttgcattatggttggcgcaaatgcttctgatagaatggggatgggaacaacctacttggccctgatggcaacattcaagatgaggcctatgtttgccgtgggcttactcttccgccggctgactagcagagaggtccttctgctaaccataggtctctcactggtggctagtgcggagttgccaaactccctggaagagttaggggacggactcgccatgggcatcatgattctgaaacttctgacggattttcaatctcatcagttgtgggcaacactcctgagcctaaccttcatcaagactaccttttccctgcactatgcttggaaaacaatggccatggttctttcaattgtgagcctcttccccctgtgtttgagtactacctctcagaagacgacatggctgccggtcttactcggctccctggggtgcaagcctcttaccatgtttctgatcgccgaaaataaaatatggggaagaaagagctggccattgaacgagggtatcatggctgtaggcattgtgtcgatcctcctgtcatctctactgaaaaacgacgttccccttgcagggcctctcattgccggaggcatgctgatcgcgtgttacgtgataagtggttccagcgctgatttgtctttagaaaaggccgcagaggtcagctgggaggaagaggccgaacattccggggcttcacacaatattctggtggaggtacaggacgatggaactatgaaaatcaaggacgaagaacgagatgacacactcaccatcctgcttaaagcaactctgttggccgtgagtggcgtcttccccctaagcattccagcgacactgttcgtttggtatttttggcaaaagaagaaacagcgctctggcgtgctctgggataccccttcacccccagaggtggaacgggctgtcctggacgacgggatatacagaatcatgcagaggggacttttaggtcgtagccaggtgggcgttggggtattccaagagaacgtgtttcatacgatgtggcacgtcactcgcggagccgtgctgatgtatcagggcaagcggctcgaaccgagttgggcaagcgttaaaaaggatttgatttcctacggtgggggatggagactgcagggctcttggaataccggcgaggaggtgcaggtcatcgccgtggaacctgggaaaaaccccaagaatgtacaaacagctccaggaaccttcaagacacccgagggtgaagtcggcgccattgcactcgactttaaacctgggacttcgggaagcccaatcgtgaacagggagggcaagatagttggtctgtacgggaatggagtggtcaccacgtcaggcacatatgtgtccgctatcgcccaggcgaaagccagtcaggaaggcccccttcctgagattgaggatgaagttttccgaaagcggaacctgactatcatggacttgcacccggggtctggaaaaacccgcagatacctaccagcaattgtgagggaggctatcaagcggaagctgcgaacactcatattagcccccaccagagtcgtggctagcgaaatggcagaggccctgaaaggtatgcctattcgctatcaaactaccgccgtaaagtccgaacatacaggcaaagagatcgtggatcttatgtgccacgctacgtttactatgaggctgctctcaccagttcgtgtccccaattacaacatgatcattatggacgaggcgcatttcaccgatccttctagcatcgcagcccgggggtatataagtacaagagtgggaatgggcgaagctgccgcaatttttatgaccgccactccgcccggttccgtggaggctttcccacagagcaatgcggtcatccaggacgaagagagggatattcctgaacgctcttggaactcagggtacgagtggatcacagactttcccggaaagaccgtatggttcgtgccatccataaaaagtggcaatgatattgccaactgtttgcgaaagaatggcaagagagttatccagctgagccggaaaacgttcgacactgagtatcaaaagaccaaaaataacgactgggattacgtggtcaccaccgacatctcggaaatgggggcaaattttagggctgatcgcgtgattgaccctcgtagatgcctcaagcccgttatcctgaaagatggaccagagcgggtgattcttgccggtccgatgcctgtcactgtggcatctgccgctcagaggcgcggccgaatagggagaaaccacaataaggaaggagaccagtacatctatatgggccagcccctaaacaatgatgaggaccatgcccactggacagaggcgaagatgctgttggataacattaataccccagaaggtatcatccccgcattattcgagcctgaacgggagaaatccgccgctattgacggggaatacaggctgcgcggcgaggccagaaagacatttgtagagctcatgaggcggggagatctgccagtgtggcttagctataaagttgcttcagaaggcttccaatacagtgaccgtcgctggtgctttgatggggagcgaaacaatcaggtcctggaagagaacatggacgtggaaatatggactaaggagggagagaggaaaaagctcaggccccggtggttgggtgcacgcacgtattctgaccctctggccctaagagagttcaaagagtttgctgccggcaggcggtccgtgagcggggatctgatcctcgaaattggaaaacttccgcagcacctgacccagcgagcacaaaatgcgttagacaacttggtcatgctgcataattcagagcagggcggtagagcctaccgccacgctatggaggaactcccagatacaatcgagactctgatgcttctggccctcattgcagttttgaccgggggcgtgacactgttctttttaagtggaaggggcctagggaagaccagcatcggactgctctgtgtaatggcttcctctgtgcttctgtggatggccagcgtcgaaccccattggatagcagcctccatcattttggagttctttctgatggtgctcctgatccctgaacccgaccggcagcgtactccacaggataaccaacttgcttatgttgtgattggtctcctgttcatgatcttgacggtcgcggccaatgagatgggcctgttagagaccaccaaaaaggacctagggataggacacgtagcagtggaaaaccaccatcacgctgccatgctggatgttgacctccatcctgcctcagcatggactctttacgctgtggccaccacaattatcacccccatgatgagacacactattgagaacacaacggcgaatatctctctgaccgctatagccaaccaggcagccatcttgatgggcctggataaaggttggccaattagtaagatggacatcggggtccctctcctggctcttggctgctacagccaggtgaatccgttaactctgacagcagccgtcctcatgttggtggcgcattatgctattatcggacccggcctgcaagccaaagcaaccagggaagcccagaagcgcaccgctgccgggataatgaagaacccaacagttgatggaattgtggcaatcgacctagatcctgtagtgtacgacgctaaatttgagaagcagctgggccagatcatgctccttattctgtgtactagccaaatcttgctgatgcggacgacctgggccctctgcgaatccataacactggcgactggtcccttaaccacactttgggaggggtctccaggaaaattctggaataccactattgccgtctcaatggcaaacatcttccgaggcagctatctggctggtgccggcctcgcattttccctaatgaagagtctagggggaggcagaagggggacgggagctcagggcgagacattgggtgaaaaatggaagcgccggctgaatcagctctctaagagcgagttcaacacctacaaaagatcagggattatggaagttgaccgttccgaggccaaggaaggacttaaaaggggcgagactaccaagcacgccgtgagtcggggtacagcgaaactgcgctggtttgtcgagcgaaatttggtgaagcctgaaggcaaggtaatcgatctggggtgtggaagaggcgggtggagctattactgcgctggactcaaaaaggtgactgaggttaaaggctataccaagggtgggcccggacacgaggaaccgataccaatggcaacatacggctggaacttagtgaaactgcattctggcaaggacgtcttctttatccctcccgaaaaatgtgatacgcttctgtgcgacattggggagtcctcaccaaatcccaccatcgaggaaggaaggactctacgggtgctcaagatggtcgagccttggctgcgcggtaaccagttctgtattaagatcttgaatccgtacatgcccagcgtggttgaaacactggagcaaatgcagagaaaacacggcgggatgctcgtaaggaacccactttcgcgaaattctacccatgagatgtattgggtgagttgcggaactggcaacattgtctccgccgtgaatatgacaagccggatgctgttaaaccgttttaccatggctcacagaaagcctacgtacgaacgcgatgttgacctgggtgccgggaccaggcacgtggcagtcgagcccgaagtggccaacttggatatcataggacagcggattgagaatatcaaacatgaacacaagtcaacatggcattatgacgaggataacccttacaaaacttgggcttatcacggctcctacgaggtaaagccatctggcagcgcgagttccatggtgaatggggttgtcaagctcctgaccaaaccctgggacgtgatccctatggtgacacagattgccatgactgataccacaccattcggacaacagagagtctttaaggaaaaagttgacacccgcactcccaaggcaaaaaggggtacggctcagataatggaggtgacagcccgatggctatggggcttccttagccggaacaagaagccgagaatctgtaccagggaagagtttactcgcaaagtacgttctaatgcagccattggggctgtgttcatcgacgaaaaccaatggaactcagccaaggaggcggtcgaggatgaacggttttgggacctggtgcatagagagagggaactccacaaacagggaaagtgcgcaacctgcgtttataacatgatgggcaaacgcgagaagaagctgggtgagttcgggaaagccaagggaagtcgagctatttggtacatgtggttgggcgcccggttcctggagtttgaggcactcggcttcatgaatgaagatcactggttttccagagagaacagcctttctggggtggaaggagagggtctgcataaattaggctacatcctgagggacatatcgaagatccctgggggaaatatgtatgctgatgacacagccggctgggatacgcgcattaccgaggacgatttgcagaacgaagctaaaatcactgacattatggagccagaacacgccctcctggcaaaggcgatcttcaaactaacataccagaataaggtcgtgagagtacaacggcccgccaagaacggtaccgttatggatgtgatatcaaggcgtgaccagcgagggagcggacaggtcggcacttatggccttaatacatttaccaacatggaggctcagctgattcgccaaatggaatccgaggggatcttcagtccttctgagctcgaaacaccaaacctggccgagagagtgttggattggttaggaaaatacggtgtggaacggctgaagaggatggcaatcagcggcgacgactgtgtcgttaaacccattgatgaccgctttgctactgccctcaccgcacttaatgatatggggaaggtgagaaaagacataccgcagtgggagccttccaagggatggaacgattggcagcaggtacccttctgctcacatcactttcaccaactgatcatgaaggacggccgggaaattgtggtcccatgtaggaatcaggatgagctagtgggtcgagcccgtgttagtcagggggcgggatggtctctgagagagacggcttgcctcggcaaaagctatgcccagatgtggcaattgatgtacttccatcgccgggacctgaggcttgcagccaacgctatctgttccgccgtgcctgtcgattgggtgcccacctcaagaacaacttggagcattcacgcacatcaccagtggatgaccacagaagacatgctgtctgtatggaatcgcgtttggatcgaggaaaacccatggatggaggataagactcatatatccaattgggaagacgtgccctatctcggcaaacgggaggaccagtggtgcgggagtttaatcggactgaccgctagggccacgtgggcgacaaacattcaagtcgctatcaatcaggtgcgaagattgattggtaacgagaattacctggattacatgaccagcatgaagcggtttaaaaacgaatcggaccctgagggcgccctctggtga

SEQ ID NO: 13212 - RNA, 9879 nt, synthetic construct
  misc_feature 1..9879: note = derived and/or modified CDS sequence (opt3) from DENV-1__KF971869__SS-prME
  source 1..9879: mol_type = other RNA
agcgtgacaatgctgctcatgcttatgcccacagcactggctttccacttgactacgagaggaggggagcctcatatgatggtctccaagcaggaaaggggaaaatctttactgtttaagacatcagccggtgttaacatgtgcacactaatcgccatggacctcggcgagctgtgtgaagatactatgacctacaaatgcccacggattacagaggcggaaccggacgatgtggactgttggtgcaatgctaccgatacttgggtaacatatgggacctgtagtcaaacgggagagcaccgccgagacaagcgtagcgtggcccttgcaccccatgtcggcctgggtttggagactagaaccgaaacatggatgtcctctgagggggcctggaaacagatacagagggtggaaacttgggctctccggcaccctggattcaccgttatcgcactgtttctggcccatgctattggcacatcgatcacccagaagggcattatcttcatactcttaatgctggtgacgccatcaatggccatgcgctgcgtcgggatcggaagcagagattttgtggagggtcttagtggcgcgacttgggtagacgttgtgttggagcacgggtcctgtgtcacaaccatggcaaaggataaacccactctggacattgaactactcaagacagaggtgaccaaccctgccgtgctgaggaaactttgcatcgaagctaagatttctaatacgaccacagatagccggtgtccaactcaaggagaggccaccctggtcgaagaacaggacgcaaacttcgtttgccgccgaacatttgtggatagaggctggggtaatgggtgtggattgttcggcaaaggctccctcatcacttgcgctaagtttaagtgcgtaaccaaactggaggggaagatagtgcagtacgaaaacttaaaatattcagtcattgtgacagttcacaccggagaccagcatcaagtgggtaatgagagtactgaacacggcacgacagccaccatcactccccaggcgcctaccacagagattcagctgaccgactacggggccctcactcttgattgtagcccaaggacaggactggacttcaacgaaatggtcttgctaacgatgaaggagaaatcttggctggtgcataagcagtggtttctcgatctgccgcttccctggacctccggcgcatcaactagccaagagacatggaatcggcaggacctgttggtaaccttcaaaacagctcacgccaagaagcaggaagttgtggtcctcggtagtcaagagggggctatgcacactgccctgaccggcgcaacggaaatccagacctctggaacaactaccatctttgccggccatttaaaatgccgtctgaagatggataaactaacactcaaggggatgtcctatgtgatgtgtactggatcgttcaaactggagaaggaagtcgctgagacccagcacggtacggtgcttgttcagattaagtacgagggcacagacgcgccttgcaaaataccattctcgacccaagatgaaaagggggtgactcagaacggacgcttgatcacagcaaatcccattgtaaccgacaaagagaagcctgtcaacatcgaagccgagccaccctttggcgagtcttatatagtgattggtgctggggaaaaagccctgaagctctcctggttcaagaaaggctcaagtatcggaaagatgtttgaggcaactgccagaggcgctaggcggatggccatcctgggggataccgcatgggacttcggaagcattggtggcgtttttacatccgtggggaaacttgtccatcagatcttcggaacggcgtacggcgtgctgttttctggtgtaagctggaccatgaagattgggataggcgtgttgctcacttggctgggattaaattcacgaagtacatccctgagcatgacctgtatcgctgttggcctagtcacactctacctgggggtgatggtgcaggccgattctggatgcgtcattaactggaaaggccgcgaacttaagtgtggttcagggatcttcgttactaatgaggtgcacacctggacggaacaatataagtttcaggcagacagtccgaaaagattgagcgccgctatcggaaaggcctgggaggagggcgtgtgcggtattaggtccgcaacacggctggaaaacataatgtggaaacagatctctaacgagctcaatcatattctgttagaaaacgacatgaagttcaccgtagtcgtgggcgatgttgctgggatcctggcccagggcaagaagatgattcgccctcaacccatggagtacaaatattcgtggaaaagctggggcaaggcgaagatcataggggccgacgtgcagaatactacctttatcattgatggaccaaacacacctgaatgtcccgacgatcagagagcttggaatatctgggaggtcgaggactacggcttcggtatttttactaccaacatctggcttaagttgagggattcctatacacaggtgtgcgaccaccgtctcatgtcagcagccataaaagatagtaaggctgttcacgccgacatggggtactggattgaatctgagaaaaatgatacgtggaagctggcacgggcgagcttcatcgaagtgaagacctgtatttggccaaaatcccatactctatggtcaaacggagtactggagagcgaaatgatcatacccaagatctatggcggtcctatttctcaacacaattaccgaccaggctacttcacacagaccgccgggccgtggcatctcggaaaactggagcttgactttgatttgtgcgagggcactacagtcgtggtggacgaacactgcgggaacagaggaccctccctgaggaccacgactgtcaccggcaagatcattcacgagtggtgttgccgcagttgtacattacctccactccggttcagaggtgaagacgggtgctggtatggaatggagatcaggcccgttaaagagaaggaagagaatctggtgaagtccatggtatctgctggctccggtgaagtggattcatttagtcttggcctgttgtgtataagcattatgatcgaggaagtcatgcgctcgcgatggtcccggaaaatgctcatgatcgggaccctggccgtgttctttctactgattatgggacagctcacttggaacgacctgatccgtctttgcattatggttggcgcaaatgcttctgatagaatggggatgggaacaacctacttggccctgatggcaacattcaagatgaggcctatgtttgccgtgggcttactcttccgccggctgactagcagagaggtccttctgctaaccataggtctctcactggtggctagtgcggagttgccaaactccctggaagagttaggggacggactcgccatgggcatcatgattctgaaacttctgacggattttcaatctcatcagttgtgggcaacactcctgagcctaaccttcatcaagactaccttttccctgcactatgcttggaaaacaatggccatggttctttcaattgtgagcctcttccccctgtgtttgagtactacctctcagaagacgacatggctgccggtcttactcggctccctggggtgcaagcctcttaccatgtttctgatcgccgaaaataaaatatggggaagaaagagctggccattgaacgagggtatcatggctgtaggcattgtgtcgatcctcctgtcatctctactgaaaaacgacgttccccttgcagggcctctcattgccggaggcatgctgatcgcgtgttacgtgataagtggttccagcgctgatttgtctttagaaaaggccgcagaggtcagctgggaggaagaggccgaacattccggggcttcacacaatattctggtggaggtacaggacgatggaactatgaaaatcaaggacgaagaacgagatgacacactcaccatcctgcttaaagcaactctgttggccgtgagtggcgtcttccccctaagcattccagcgacactgttcgtttggtatttttggcaaaagaagaaacagcgctctggcgtgctctgggataccccttcacccccagaggtggaacgggctgtcctggacgacgggatatacagaatcatgcagaggggacttttaggtcgtagccaggtgggcgttggggtattccaagagaacgtgtttcatacgatgtggcacgtcactcgcggagccgtgctgatgtatcagggcaagcggctcgaaccgagttgggcaagcgttaaaaaggatttgatttcctacggtgggggatggagactgcagggctcttggaataccggcgaggaggtgcaggtcatcgccgtggaacctgggaaaaaccccaagaatgtacaaacagctccaggaaccttcaagacacccgagggtgaagtcggcgccattgcactcgactttaaacctgggacttcgggaagcccaatcgtgaacagggagggcaagatagttggtctgtacgggaatggagtggtcaccacgtcaggcacatatgtgtccgctatcgcccaggcgaaagccagtcaggaaggcccccttcctgagattgaggatgaagttttccgaaagcggaacctgactatcatggacttgcacccggggtctggaaaaacccgcagatacctaccagcaattgtgagggaggctatcaagcggaagctgcgaacactcatattagcccccaccagagtcgtggctagcgaaatggcagaggccctgaaaggtatgcctattcgctatcaaactaccgccgtaaagtccgaacatacaggcaaagagatcgtggatcttatgtgccacgctacgtttactatgaggctgctctcaccagttcgtgtccccaattacaacatgatcattatggacgaggcgcatttcaccgatccttctagcatcgcagcccgggggtatataagtacaagagtgggaatgggcgaagctgccgcaatttttatgaccgccactccgcccggttccgtggaggctttcccacagagcaatgcggtcatccaggacgaagagagggatattcctgaacgctcttggaactcagggtacgagtggatcacagactttcccggaaagaccgtatggttcgtgccatccataaaaagtggcaatgatattgccaactgtttgcgaaagaatggcaagagagttatccagctgagccggaaaacgttcgacactgagtatcaaaagaccaaaaataacgactgggattacgtggtcaccaccgacatctcggaaatgggggcaaattttagggctgatcgcgtgattgaccctcgtagatgcctcaagcccgttatcctgaaagatggaccagagcgggtgattcttgccggtccgatgcctgtcactgtggcatctgccgctcagaggcgcggccgaatagggagaaaccacaataaggaaggagaccagtacatctatatgggccagcccctaaacaatgatgaggaccatgcccactggacagaggcgaagatgctgttggataacattaataccccagaaggtatcatccccgcattattcgagcctgaacgggagaaatccgccgctattgacggggaatacaggctgcgcggcgaggccagaaagacatttgtagagctcatgaggcggggagatctgccagtgtggcttagctataaagttgcttcagaaggcttccaatacagtgaccgtcgctggtgctttgatggggagcgaaacaatcaggtcctggaagagaacatggacgtggaaatatggactaaggagggagagaggaaaaagctcaggccccggtggttggacgcacgcacgtattctgatcctctggccctaagagagttcaaagagtttgctgccggtaggcggtccgtgagcggcgacctgatcctcgaaattgggaaacttccgcagcacctgacccagcgagcacaaaatgcgttagataacttggtcatgctgcataattcagagcagggaggcagagcctaccgccacgctatggaggaactcccagacacaatcgagactctgatgcttctggccctcattgcagttttgaccggtggggtgacactgttctttttaagtggcaggggactaggcaagaccagcatcgggctgctctgtgtaatggcttcctctgtgcttctgtggatggccagcgtcgaaccccattggatagcagcctccatcattttggagttctttctgatggtgctcctgatccctgaacccgatcggcagcgtactccacaggacaaccaacttgcttatgttgtgattggactcctgttcatgatcttgacggtcgcggccaatgagatgggtctgttagagaccaccaaaaaggatctaggcatagggcacgtagcagtggaaaaccaccatcacgctgccatgctggacgttgatctccatcctgcctcagcatggactctttacgctgtggccaccacaattatcacccccatgatgagacacactattgagaacacaacggcgaatatctctctgaccgctatagccaaccaggcagccatcttgatgggactggacaaaggctggccaattagtaagatggatatcggtgtccctctcctggctcttgggtgctacagccaggtgaatccgttaactctgacagcagccgtcctcatgttggtggcgcattatgctattatcggccccggactgcaagccaaagcaaccagggaagcccagaagcgcaccgctgccggcataatgaagaacccaacagttgacgggattgtggcaatcgatctagaccctgtagtgtacgacgctaaatttgagaagcagctgggacagatcatgctccttattctgtgtactagccaaatcttgctgatgcggacgacctgggccctctgcgaatccataacactggcgactggccccttaaccacactttgggagggttctccagggaaattctggaataccactattgccgtctcaatggcaaacatcttccgaggaagctatctggctggcgccggtctcgcattttccctaatgaagagtctgggcgggggaagaaggggcacgggggctcagggagagacattgggcgaaaaatggaagcgccggctgaatcagctctctaagagcgagttcaacacctacaaaagatcaggtattatggaagttgatcgttccgaggccaaggaagggcttaaaaggggagagactaccaagcacgccgtgagtcggggcacagcgaaactgcgctggtttgtcgagcgaaatttggtgaagcctgaaggtaaggtaatcgacctgggctgtgggagaggaggctggagctattactgcgctgggctcaaaaaggtgactgaggttaaaggatataccaagggcggtcccgggcacgaggaaccgataccaatggcaacatacggatggaacttagtgaaactgcattctggcaaggatgtcttctttatccctcccgaaaaatgtgacacgcttctgtgcgatattggcgagtcctcaccaaatcccaccatcgaggaagggaggactctacgggtgctcaagatggtcgagccttggctgcgcggaaaccagttctgtattaagatcttgaatccgtacatgcccagcgtggttgaaacactggagcaaatgcagagaaaacacggtggcatgctcgtaaggaacccactttcgcgaaattctacccatgagatgtattgggtgagttgcgggactggaaacattgtctccgccgtgaatatgacaagccggatgctgttaaaccgttttaccatggctcacagaaagcctacgtacgaacgcgacgttgatctgggcgccggtaccaggcacgtggcagtcgagcccgaagtggccaacttggacatcatagggcagcggattgagaatatcaaacatgaacacaagtcaacatggcattatgatgaggacaacccttacaaaacttgggcttatcacggatcctacgaggtaaagccatctggcagcgcgagttccatggtgaatggcgttgtcaagctcctgaccaaaccctgggatgtgatccctatggtgacacagattgccatgactgacaccacaccattcgggcaacagagagtctttaaggaaaaagttgacacccgcactcccaaggcaaaaaggggaacggctcagataatggaggtgacagcccgatggctatggggtttccttagccggaacaagaagccgagaatctgtaccagggaagagtttactcgcaaagtacgttctaatgcagccattggcgctgtgttcatcgatgaaaaccaatggaactcagccaaggaggcggtcgaggacgaacggttttgggatctggtgcatagagagagggaactccacaaacaggggaagtgcgcaacctgcgtttataacatgatgggaaaacgcgagaagaagctgggcgagttcggtaaagccaaggggagtcgagctatttggtacatgtggttgggagcccggttcctggagtttgaggcactcggcttcatgaatgaagaccactggttttccagagagaacagcctttctggcgtggaaggggagggactgcataaattaggttacatcctgagggatatatcgaagatccctggcgggaatatgtatgctgacgatacagccggatgggacacgcgcattaccgaggatgacttgcagaacgaagctaaaatcactgatattatggagccagaacacgccctcctggcaaaggcgatcttcaaactaacataccagaataaggtcgtgagagtacaacggcccgccaagaacggcaccgttatggacgtgatatcaaggcgtgatcagcgaggtagcgggcaggtcggaacttatggccttaatacatttaccaacatggaggctcagctgattcgccaaatggaatccgagggcatcttcagtccttctgagctcgaaacaccaaacctggccgagagagtgttggactggttagggaaatacggagtggaacggctgaagaggatggcaatcagcggtgacgattgtgtcgttaaacccattgacgatcgctttgctactgccctcaccgcacttaatgacatgggcaaggtgagaaaagatataccgcagtgggagccttccaaggggtggaacgactggcagcaggtacccttctgctcacatcactttcaccaactgatcatgaaggatggacgggaaattgtggtcccatgtaggaatcaggacgagctagtgggccgagcccgtgttagtcagggtgcggggtggtctctgagagagacggcttgcctcggaaaaagctatgcccagatgtggcaattgatgtacttccatcgccgggatctgaggcttgcagccaacgctatctgttccgccgtgcctgtcgactgggtgcccacctcaagaacaacttggagcattcacgcacatcaccagtggatgaccacagaagatatgctgtctgtatggaatcgcgtttggatcgaggaaaacccatggatggaggacaagactcatatatccaattgggaagacgtgccctatctcggcaaacgggaggatcagtggtgcggcagtttaatcgggctgaccgctagggccacgtgggcgacaaacattcaagtcgctatcaatcaggtgcgaagattgattggaaacgagaattacctggactacatgaccagcatgaagcggtttaaaaacgaatcggatcctgagggtgccctctggtga

SEQ ID NO: 13213 - RNA, 9879 nt, synthetic construct
  misc_feature 1..9879: note = derived and/or modified CDS sequence (opt3) from DENV-1__JN903578__SS-prME
  source 1..9879: mol_type = other RNA
agcgtgacaatgctgctcatgcttctgcccacagccttggctttccacttaactacgagaggcggggagcctcatatgatcgtctccaagcaagaaaggggaaaatctctgttatttaagacatcagttggtgtgaacatgtgcacactcattgccatggacctgggcgagctttgtgaagatactatgacctacaaatgcccacggataacagaggccgaaccggacgatgtagactgttggtgcaatgcgaccgatacttgggtgacatatgggacctgtagccaaacgggagagcaccgccgagacaagcgtagcgtcgctctggcaccccatgtgggcttgggtctcgagactagaaccgaaacatggatgtcctctgagggggcatggaaacagatccagagggttgaaacttgggccctgcggcaccctggattcaccgtgattgctctgtttctcgcacatgccatcggcacatcgattacccagaagggcatcatattcatcttactgatgcttgtcacgccatcaatggctatgcgctgcgtggggattggaaacagagattttgtagagggtttgagcggcgccacttgggttgacgtggtcctggagcacgggagttgtgtgacaaccatggcgaagaataaacccactctagatatcgaactcctgaagacagaggtgaccaaccctgcagtccttaggaaactgtgcattgaagccaagatctccaatacgaccacagactctcggtgtccaactcaaggagaggctaccttggttgaagaacaggatgccaacttcgtgtgccgccgaacatttgtagacagaggctggggtaatgggtgtggactcttcggcaaaggcagcctgttaacttgcgcaaagtttaagtgcgtgaccaaactggaggggaaggtcgtgcagtacgaaaacctcaaatattccgttatagtgacagtccacaccggagatcagcatcaagtgggtaatgagactacggaacacggcacaattgctaccatcactccccaggcccctacctcagagattcagcttacagactacggggcgctgaccttggactgtagtccaaggactggactagatttcaacgaaatggtactgctcacaatgaaggagaaaagctggctggttcataagcagtggtttcttgacctgccgttgccctggacgtctggcgcctccacctcacaagagacttggaatcggcaggatctcctggtgacattcaaaaccgcacacgctaagaagcaggaagtcgtggtcttaggtagccaagagggggccatgcacacagctctgactggcgccaccgaaatccagacgagtggaaccacaactatctttgcaggccatctaaaatgccgtctcaagatggacaaactgacccttaaggggatgtcttatgtgatgtgtacaggatccttcaaattggagaaggaagttgccgagactcagcacggtaccgtgctggtacaggtcaagtacgagggcacggatgctccttgcaaaattccattcctcatacaagacgaaaagggggtgacacagaacggacgcctgatcaccgcgaatcccattgttactgataaagagaagcctgtgaacatcgaaacagagccaccctttggcgagagctatatagtcgtgggtgcaggggaaaaagcccttaagctgtcgagattcaagaaaggatcttccattggaaagatgtttgaggctaccgccaggggcgcacggcgaatggccatcttgggggacactgcttgggatttcggatcaatcggtggcgtatttaccagtgtggggaaactcattcatcaggttttcggaacagcctacggcgtcctgtttagcggtgtgtcctggacgatgaagatcgggattggcatattactgacctggctaggactcaattctcgcagcacttcactgagtatgacatgtatcaccgtgggcatggtcacactttacttgggggttatggtgcaggcagactccggatgcgtgattaactggaaaggcagagaactgaagtgtggtagcgggatcttcgtaactaacgaggtccacacctggacggaacaatataagtttcaggcggattctccgaaaaggctctcagctgccatcggaaaggcatgggaggagggcgtgtgcggtattcggagtgccacacgcctggaaaatataatgtggaaacagatcagcaacgagttaaatcatattctgcttgaaaacgacatgaagttcaccgttgtggtcggcgacgctaatgggatcttggcccagggcaagaagatgattagacctcaacccatggagcacaaatactcctggaagtcttggggcaaggcaaaaatcataggggctgatatccagaacactacctttattatcgacggaccagatacacctgaatgtcccgacgatcagagggcctggaatatttgggaggtggaggactatggcttcggtatctttactaccaacatatggctcaagctgcgtgattcgtacacacagatgtgcgaccaccggctaatgagcgcggccattaaagattccaaggctgttcatgcagacatggggtattggatcgaatcagagaaaaatgaaacgtggaagctggcccgagctagtttcattgagatcaagacctgtatatggccaaaatctcacactctctggagcaacggagtgctggaatccgagatgatcattcccaagatctacggcggtcctatttcacaacataatcacagaccaggctatttcacacagaccgccgggccgtggcaccttggaaaattggagctggattttgacgtatgcgaaggcactacagtcgtggtggatgagcattgcgggaacaggggacccagcttacgcaccacgactgtcaccggcaagatcatacacgaatggtgttgccggtcttgtacactccctccactgagattcaggggtgaggacgggtgctggtacggaatggagattcgccccgttaaagaaaaggaggaaaatcttgtgcgatccatggtaagtgcaggcagcggtgaggtggactctttttccctgggcttgctctgtgtctcaatcatgatcgaagaggtgatgcggagtcgttggagcagaaagatgctgatgaccgggactctagcggttttctttctgctcattatgggacagctgacatggaacgatcttatcaggttgtgcattatggtgggcgccaatgtctcggaccgcatggggatgggaaccacatacctggctttaatggccactttcaaaatgcggcctatgtttgcagtgggcctcctgttcagaaggcttacctcccgagaggttctgctactcacgataggtctgtctttggtggctagcgccgaactgccaaactcattagaggaactcggggatggactggcaatgggcatcatgatgcttaagctgttgacagactttcaaagtcatcagctctggaccactctgctatccctgaccttcattaaaacaactctttctctcgattatgcctggaagaccatcacgatgattctgagcatcgtctccttgtttcccctgtgtttatcaacaaccagccagaaaactacatggctcccggtactgcttggcagtttcgggtgcaagcctctgaccatgtttttgataactgagaacaagatctggggacgcaaatcttggccactcaatgaaggtattatggctgtgggcatcgtttccattctgctaagctcgctgcttaagaacgacgtgcccctcgcggggcctctgatcgccggaggcatgttgatagcatgttacgtcatttcaggttctagtgctgatttatccctggagaaagccgccgaggtgagctgggaagaggaagctgagcactctgggacaagccataatatcctcgtagaagtgcaggacgatggaaccatgaagatcaaagacgaggagcgggatgacacgctgactattcttctgaaggcaaccttgctagccgtctccggcgtttatcccatgtcaataccagcgacactgttcgtgtggtacttctggcagaaaaagaagcagagaagtggcgtgctctgggatacccctagtcccccagaagtcgagagggctgtgctggacgacgggatctatcgtattcttcagcgcggattactgggtcggtctcaggttggcgtaggggtgtttcaagatggagtcttccacacaatgtggcacgtgactagaggcgccgttctcatgtaccagggtaaaaggttggaaccgtcctgggcatcagtgaagaaagacctgatcagttatgggggaggctggcgatttcagggcagctggaacaccggggaggaggtccaggtgattgccgtagaacctggaaagaatcccaaaaacgtccaaacgacaccaggtactttcaagacccccgagggcgaagtgggggctatcgcactcgattttaagcctggaacatccggctctccaatagttaatcgggagggtaaaatcgtggggctgtacggaaacggcgtcgtgaccacttcgggcacctacgttagcgccattgcgcaggctaaggcctcacaggaagggccccttcctgagatcgaggacgaagtgttcaaaaagcgcaatctgacaattatggatttgcatccgggatccggtaaaacgagaaggtatctaccagcaatcgtccgggaggccataaagcgaaagctgagaactctcattttagctcccacccgcgtggtagccagtgaaatggcagaggctctgaaaggcatgcctatcaggtaccaaacaaccgccgtgaagtctgaacacactgggcgtgagatcgttgaccttatgtgccatgcgacatttaccatgcggctgctcagcccagtcagagtgcccaactataatatgattatcatggatgaggcccacttcacggaccctgcatccatagctgccaggggatacatttcaactcgcgtgggcatgggtgaagctgcagccatctttatgacagccaccccgcccgggtctgtcgaggctttcccacagagcaacgcggtaattcaggatgaagagaaagacatccctgaacgaagttggaactccggatatgattggataaccgactttcccggcaagactgtgtggttcgttccaagcattaaatctggcaatgacatcgcaaattgtttgagaaagaacgggaagcgggtgatccagctgtcaaggaaaacattcgataccgagtaccaaaagaccaaaaacaatgactgggattatgtcgtgactacggacatttccgagatgggagccaactttcgcgctgatcgtgttatcgaccctagacggtgcctcaagcccgtgattctgaaagatggtccagaaagggtcatacttgccggcccgatgcctgtgaccgtagcaagtgccgctcagcgccgagggagaatcggacggaatcagaacaaggagggcgaccagtacgtgtacatgggtcaacccctaaataacgatggggaccatgcgcactggacagaagccaagatgctgttggataatattaacactccagagggcatcatccccgcattattcgagcctgaaagggagaaaagcgctgccattgacggagaatatcgcctgagaggcgaggcaaggaagacctttgttgaactcatgcggcgtggggatctgccagtctggctttcgtacaaagtggcctctgagggattccagtattccgaccgccgatggtgctttgacggtgagagaaataaccaggtgctggaagagaatatggatgtcgaaatatggacaaaggagggcgaaaggaaaaagctccggccccgctggttggacgctagaacctacagcgatcctctggccctaagggagttcaaagagtttgcggcagggcggcgatcagttagtggagacctgatcctcgaaattggcaaacttccgcagcacctgactttaagagcccaaaacgctttggataatctggtgatgctccataactctgagcagggtgggaaggcctatcgccacgctatggaggaactgccagacacgatcgaaacccttatgctgctcgcattgattgccgtactgacaggcggagtgactttattctttctatccggcaaagggctgggaaagaccagcatcggtctcctttgtgtcatggcttcaagtgccctgttgtggatggcaagcgtggagccccattggatagcggcctccatcattctggagttctttctcatggttctgcttatccctgaacccgataggcagcggacaccacaggacaatcaactcgcttacgtggtcattggcctgttgttcatgatcctgaccgtagccgcaaacgagatggggttactagaaactaccaaaaaggatctgggaataggccacgtggctgccgagaaccaccatcacgcaacgatgctcgacgttgatcttcgtcctgcctctgcttggaccctgtatgcggtggccactacagtcattacccccatgatgagacataccatcgagaatacaactgcaaacattagcttgacggctatcgccaatcaggccgcaatactgatgggtctcgacaaagggtggccaatctccaagatggatattggcgtgcctctgcttgctttaggatgctactcacaggtcaacccgctgaccctcacagccgcggtgttgatgctggttgctcactacgccatcattggccccgggctacaagcaaaggccactagggaagctcagaaacgcaccgcagccggaatcatgaagaatccaacagtggacggcatagtagcgattgacctggatcctgtggtctatgacgctaaatttgagaagcagctcggtcagatcatgcttctgatcttgtgtacctctcaaattctgctcatgcggactacgtgggccctgtgcgaaagtatcacattagcaaccgggccccttactaccctgtgggagggatcgccaggcaaattctggaacacaactatagccgttagcatggctaatattttccgaggttcctacctcgccggcgcagggctagctttttctctgatgaagtcattgggaggcagcagaagggggaccggagcccagggcgaaacactgggtgagaagtggaaacgccagctcaaccagctttccaagagtgagttcaatacgtataaacggtctgggatcatggaagtggatagaagcgaggcgaaggaaggactgaaacgtggcgagaccactaagcatgccgtctcaaggggtacagcaaagttgcggtggtttgtggaacgcaacctggtaaaacctgagggcaaggtgattgacctcgggtgtggacgaggcgggtggtcctactattgcgctggactgaaaaaggttaccgaggtgaaaggctacactaagggtgggcccggacacgaggaaccgatcccaatggccacatatggctggaatctagtcaaacttcacagtggcaaggatgtgttctttatacctcccgaaaagtgtgacaccctgctatgcgatatcggggagagctctccaaaccccacgattgaagagggaagaaccctcagggtcctgaaaatggtggagccttggttgcggggtaatcaattctgtatcaagattctgaacccgtacatgccctccgttgtagaaacactcgagcagatgcagcgcaaacatggcgggatgcttgtgagaaatccactgtcaaggaacagcactcacgaaatgtactgggtctcgtgcggaaccggcaatatcgtgtctgcagttaacatgacaagtcgaatgttactgaaccggtttactatggctcatcgtaagcctacctatgagagagacgtggatttgggtgccgggacacgccacgtcgccgtggagcccgaagtagcgaatctcgacattatcggacagaggatagagaacattaaaaatgaacacaagtccacctggcattacgatgaggacaacccttataagacttgggcttaccacggcagctatgaagtgaaaccatcaggctccgcatctagcatggttaatggggtcgtgcggctgctaacgaagccctgggacgtgatccctatggtcacacaaatcgccatgaccgatactaccccattcggacagcagagagtttttaaagagaaggtggacacacgcacgcccagggctaaacgaggtaccgcccaaattatggaggtaactgcaaagtggctttggggcttcctgagtcggaacaagaaaccgagaatatgtacaagggaagagtttacccgcaaggtgcgttccaatgccgctatcggggcggtcttcgtggatgaaaaccagtggaatagcgccaaagaggcagttgaagacgagcggttttgggatctcgtgcatagagagagggaactgcacaagcagggaaaatgcgctacttgcgtctacaacatgatgggcaagcgcgagaagaaattgggtgagttcgggaaggccaaaggatctcgagcaatttggtatatgtggctgggcgcccggttcctcgagtttgaagctcttggcttcatgaatgaggaccattggttttcaagagagaacagtctgtccggggtggaaggagagggtttacacaagctgggctacatcttgagggatattagcaaaatccctgggggaaatatgtacgccgacgatacagcgggctgggacacccgcataacagaagatgacctccagaacgaggcaaagatcactgatattatggagccagaacacgccctgctagctacctctatcttcaaacttacgtatcaaaataaggtagttagagtgcagcggcccgccaagtcgggtaccgtcatggacgtgatttcaaggcgtgaccagcgagggagcggacaggtgggcacatacggcctgaacacttttaccaacatggaggtccaactcatccgccagatggaatccgaggggatattcctgcctagtgaattggagacaccaaatttagcaaaaagagttctggattggctcgagaagcatggagctgaacggcttaaaaggatggccatttctggtgacgattgtgtggtaaagcccatcgacgatcgctttgctactgccctgaccgcactaaacgacatgggcaaagtgagaaaggatatcccgcagtgggagcctagcaaggggtggaatgactggcagcaagtccccttctgctcccaccattttcaccagctgattatgaaagatggacgggaaatagtggttccatgtaggaaccaggacgagctcgtgggccgagcgcgtgtctcacagggtgccgggtggagtttgagagaaacggcttgcctgggaaagtcttatgcccaaatgtggcagcttatgtacttccaccgccgggatctgaggctcgcagctaatgccatctgtagcgcagtgcctgtagactgggttcccacatccagaaccacttggtcaattcatgcccaccatcagtggatgacaaccgaggacatgttaagcgtgtggaaccgcgtctggatcgaggaaaatccatggatggaggataaaactcacgtgtcttcctgggaagaggttccctatctgggcaagcgggaagaccaatggtgcggcagtttgattgggctgaccgcgagggctacatgggccacgaacatccaggtggcaataaatcaggtccgaagactcatcggaaacgagaattaccttgattatatgaccactatgaaacggtttaagaacgagagcgaccctgaaggtgccctgtggtga

SEQ ID NO: 13214 - RNA, 9879 nt, synthetic construct
  misc_feature 1..9879: note = derived and/or modified CDS sequence (opt3) from DENV-1__JN903579__SS-prME
  source 1..9879: mol_type = other RNA
agcgtgaccatgctgctcatgcttctgcccacagccttggctttccacttaactacgagaggcggggagcctcatatgatcgtcggaaagcaggaaaggggtaaatccctgctatttaagacctctgcaggcgttaacatgtgcacactcattgccatggacctgggggagctttgtgaagatactatgacctacaaatgcccacggataacagaggcggaaccggacgatgtggactgttggtgcaatgctaccgatacttgggtaacatatggaacctgttcacaaacgggcgagcaccgccgagacaagcgtagtgtggccctggcaccccatgtcggtttggggctcgagactagaaccgaaacatggatgagctccgagggagcctggaggcagatccagaaagtggaaacttgggctctgcggcaccctggcttcaccgttattgcactgtttctcgcccatgctatcggcacatctattacccagaaggggatcatattcatcttactgatgcttgtgacgccatcgatggccatgcgctgcgtcggaattggtaacagagattttgtggagggcttgtcaggggcgacttgggtagacgttgtgctggagcacggaagctgtgtcacaaccatggcaaagaataaacccactctagatatcgaactcctgaagacagaggtgaccaaccctgccgtgcttaggaaactgtgcattgaagctaagatcagtaatacgaccacagactcccggtgtccaactcaaggcgaggccaccttggtcgaagagcaggatgcaaacttcgtttgccgccgaacatttgtggacagaggttgggggaatggatgtggcctcttcggcaaagggtctctgttaacttgcgctaagtttaagtgcgtaaccaaactggagggaaagatagtgcagtacgaaaacctcaaatatagcgtcattgtgacagttcacaccggtgatcagcatcaagtgggcaatgagactacggaacacgggacaatcgccaccattactccccaggcgcctacctccgagatccagcttacagactacggagccctgaccttggactgttcaccaaggactggcctagatttcaacgaaatggtcctgctcacaatgaaggagaaaagttggctggtgcataagcagtggtttcttgacctgccgttgccctggacgagcggtgcatctacctcccaagagacttggaatcggcaggatctcctggtaacattcaaaaccgctcacgccaagaagcaggaagttgtggtcttagggtcacaagagggcgctatgcacacagccctgactggagcaaccgaaatccagacgagcggcaccacaactatttttgccgggcatctaaaatgccgtctcaagatggacaaactgacccttaagggagtgagttatgtcatgtgtacaggttctttcaaattggagaaggaagtggctgagactcagcacggcaccgttctggtgcaggtaaagtacgaggggacggatgcgccttgcaaaataccattctccacacaagacgaaaagggagtcacccagaacggccgcctcatcactgcaaatcccattgtgacagataaagagaagcctgttaacatcgaaaccgagccaccctttggtgagagctatatagtgattggggccggcgaaaaagctctgaagctttcgtggttcaagaaaggatcttccatcggcaagatgtttgaggccactgcaagaggggccaggcggatggctatcctgggagacaccgcctgggatttcggttcaattggcggggtctttacaagtgtgggaaaattggtacatcaggtgttcggcacggcatacggtgttctctttagcggggtctcctggaccatgaagatcggcattggaatactgttaacttggctgggcctaaattctcgaagcacatcactcagtatgacctgtatcgcggtggggatggtgacactgtaccttggagtcatggttcaggctgacactggctgcgtgattaactggaaaggtcgcgaattgaagtgtgggtccggaatcttcgtgaccaacgaggtacacacgtggacagaacaatataagtttcaggccgatagcccgaaaagactgtctgcagccatcggcaaggcttgggaggagggtgtctgcggcattaggtcagccacccggctcgaaaatataatgtggaaacagatcagtaacgagctgaatcatattttactggaaaacgacatgaagttcactgtggttgtgggggacgcaaatggaatccttacccagggcaaaaagatgattcgccctcaacccatggagcacaaatacagctggaagtcctgggggaaggctaaaatcataggagccgatacacagaacactacctttatcattgacggcccagatacacctgaatgtcccgacgatcagagagcgtggaatatctgggaggtcgaggactatggtttcgggatttttacgaccaacatctggttgaagctcagggattcttacactcagatgtgcgaccaccgtctgatgtcggccgctataaaagatagcaaggcagtgcatgccgacatgggatattggattgaatccgagaaaaatgaaacatggaagctagctcgggcctcattcatcgaggttaagacctgtatttggccacgaagtcacactctgtggtctaacggcgtgctcgaaagcgagatgatcatacccaaaatctacggtggccctatttcccaacataattatagaccagggtacttcacacagaccgcaggaccgtggcacctgggcaagcttgagttggattttaacctgtgcgaagggacgactgtagtcgtggacgagcactgcggaaataggggcccctcattacgcaccacaaccgtgactggtaaaatcattcatgaatggtgttgccggagctgtacactccctccactgagattcaggggggaggatggatgctggtacggcatggagatccgccccgtcaaggaaaaagaggaaaaccttgttcgatctatggtgtccgcgggtagtggcgaggtagacagcttttctctggggttgctctgtgtgtccataatgattgaagaggtcatgcggtcacgttggagtagaaagatgctgatgaccggaacactagccgtgttctttctgctcatcatgggccagctgacttggaatgaccttatcaggttgtgcattatggttggggctaacgtgagcgatcgcatgggaatgggcaccacgtatctggccttaatggcaacattcaagatgcggcctatgtttgctgtcggtctcctgttcagaaggcttacctcgcgagaggtgctgctactcactatcgggctgtccttggttgcctctgcagaactgccaaacagcttagaggaactcggagacggcctggccatgggcattatgatgcttaaactgttgaccgattttcaatcacaccagctctggacaactctgctaagtctgaccttcataaagacgacactttccctcgactacgcttggaaaaccatcgcgatgattctgtctatcgtgagcttgtttcccctgtgtttatccactacatcacagaagaccacttggctcccggtcctgcttgggagcttcggatgcaaacctctgacaatgtttttgattaccgagaataagatctggggtcgcaagagttggccactcaacgaaggcataatggccgtagggatcgtgtctattctgctatccagcctgcttaaaaatgatgttcccctcgcaggacctctgatcgctggcggtatgttgattgcctgttatgtgatctcggggtcatctgccgacttaagtctggagcgggctgcagaggtctcctgggaagaggaagccgagcatagcggagcgtctcacaacatactcgtggaagtacaggatgacggcacgatgaagattaaagatgaggagagagacgatactctgaccatccttctgaaggctacattgctagccgtgagcggcgtctaccccatgtccatcccagcaaccctgttcgtttggtatttctggcaaaaaaagaaacagaggtcaggggtgctctgggacacacctagtcccccagaagtggagcgtgccgtcctggatgacggaatttaccgcatacttcagcggggtttactgggcagaagccaggtgggggttggagtatttcaagacggcgtgttccatactatgtggcacgtcaccaggggtgctgtgctcatgtatcaggggaagcgattggaaccgtcttgggcatccgttaagaaagatctgatctcatacggaggcggctggcggtttcaggggagttggaatacgggagaggaggtgcaggtcattgccgtggaacctggtaagaaccccaaaaatgtacaaacaactccaggcaccttcaagacacccgagggggaagtcggagcgatcgctctcgactttaaacctggcaccagcggttccccaattgtgaaccgcgaggggaagatcgttggactgtacggcaatggcgtggtcactacctctgggacatatgtgtcggccatagcacaggccaaggctagccaggaaggaccccttcctgagatcgaggatgaagttttcaaaaagagaaacctgacgattatggacttgcacccgggttcaggcaaaactaggcggtacctaccagccatcgtgcgagaggcaattaagagaaaactgcgcaccctcatcttagctcccacaagggtcgtggcctccgaaatggcggaggccctgaaggggatgcctatacgttatcaaaccactgcagtaaagagtgaacatacaggacgggagattgtggatcttatgtgccacgctacctttacgatgagactgctctctccagttagggtccccaattacaacatgatcatcatggacgaggcccatttcactgatcctgctagcattgcagcccgcggctatatctccacacgagtgggtatgggggaagccgctgcgatatttatgaccgcaaccccgcccggatcagtggaggccttcccacagtctaatgctgtcattcaggacgaagagagagatatccctgaacggagctggaacagtggctacgactggattactgattttcccggcaaaacagtatggttcgtgccatccatcaagagcgggaatgacatagccaactgtttgaggaaaaacggaaagcgcgttattcagctgtctcgtaaaaccatcgacacagagtatcaaaagactaagaataacgattgggactacgtggtcacgaccgatatctcagagatgggtgcaaatttcagagccgaccgggtgattgatcctaggcgctgcctcaaacccgttatcctgaaggacggcccagaacgagtgattcttgctgggccgatgcctgtcacagcggcctccgcagctcagagacggggaaggataggccgcaaccagaataaagagggtgatcagtacatctatatggggcaacccctaaacaatgacgaagatcacgcccattggactgaggcaaagatgctgttggacaacattaataccccagagggcatcatccccgccttatttgaacctgagagagaaaaaagtgctgccattgatggagagtacaggctgcggggcgaagcgcgtaagacattcgtggagctcatgcgccgaggggacctgccagtatggcttagctataaggtggcatcggagggatttcagtactctgatagaaggtggtgcttcgacggtgaacggaacaatcaggttctggaggaaaacatggacgtcgagatatggaccaaagaaggcgagcgcaagaaactcagacccaggtggttggatgcccggacttattccgaccctctggctctacgagagtttaaggaattcgccgctgggagacgcagcgtgtcaggagatctgatcctcgagattggcaaacttccgcagcacctgacgttaagggcacaaaatgccttggacaacctggtgatgctccacaatagtgaacagggtgggaaggcttaccggcatgccatggaggaactgccagataccatcgagacacttatgctgctcgcattgattgcggtcctgactggcggagttaccttatttttcctatctggcaaagggctgggaaagacatccatcggtctcctttgtgtgatggccagctcagtactgttgtggatggctagtgtggagccccactggatagccgcaagcatcattctggaatttttcctcatggtcctgcttatccctgagcccgaccgtcagagaaccccacaggataaccaactcgcttatgtggttattggctccctgtttatgatcttgactgtggccgcaaacgaaatggggctgttagagacaacgaagaaagacctaggaataggccatgtcgtagccgagaatcaccaccatgctaccactctggatattgacctccaccctgcgtctgcctggacactttacgcagtggctaccaccatcattacacccatgatgaggcatactatcgaaaacacgaccgccaatataagcctgacagccatcgcaaaccaggctgccattttgatgggtctggataaggggtggccaatctccaaaatggacattggcgttcctctcctggcgcttggatgctactcacaggtgaatccgttaactctgaccgctgccgtcctcatgttggtggcacactatgccatcataggccccgggctgcaagctaaggcaacacgcgaggcccagaaacggaccgcggctggaattatgaagaacccaactgtcgatggcatcgtggccatcgacctagaccctgttgtgtacgatgcaaagttcgaaaaacagctgggtcagattatgctccttatcctgtgtacgtctcaaatattgctgatgcgaacaacctgggccctctgcgagagtattactctggctaccgggcccttaacaactctttgggaaggatcgccaggcaagttttggaataccacaatcgccgtaagcatggcaaacattttcagaggttcctatctggctggcgccgggctcgcgttctctctaatgaaatcactgggaggcgggaggcgcggaacgggcgcccagggtgagaccttgggggagaagtggaaacggcagctgaatcagctcagcaagtccgaatttaacacttacaagagaagtggaatcatggaggtggaccgttctgaagcaaaagagggccttaagaggggtgaaacaaccaaacatgctgtcagccggggcactgccaagctgcgctggttcgttgagcgaaatttggtgaaacctgaggggaaggtcatagatctgggatgtggcagagggggatggtcatattactgcgcaggcctcaagaaagtgacagaagtaaagggttataccaaagggggacccggccacgaggaaccgatcccaatggctacgtacggctggaacattgtgaagttacactccgggaaagacgtttttttcacccctcccgagaagtgtgatacactgctttgcgacatcggagaaagtagcccaaatcccactattgaggagggtaggaccctgcgggtgctaaaaatggtcgaaccttggctccgcggcaaccaattttgtatcaagattctgaatccgtacatgccctctgtggtcgagacattggaacagatgcagagaaagcatgggggaatgctggtgaggaacccactctcccgaaattcaactcacgagatgtattgggttagctgcggcaccggtaacatcgtatcggccgtgaacatgacatctcggatgcttctgaatcgtttcaccatggcccatagaaaacctacttacgagcgcgatgtcgacttaggggcgggaacgaggcacgtggctgttgaacccgagatagcaaacctggatattatcggccagcggatcgaaaatattaagaacgagcacaaaagtacatggcattatgacgaagataatccttacaagacctgggcctatcacggctcctacgaggtgaaaccaagcgggtcagcttcctctatggtcaacggagtggtaagattgctcactaagccctgggacgtgatacctatggttacccaaatcgccatgacagacacgaccccatttggtcagcagcgcgtcttcaaggagaaagtggatactaggacaccccgaccgaagcggggcaccgcacaaattatggaagtgactgccaaatggctgtgggggtttctaagcagaaataagaaacctaggatctgtacacgcgaggaattcacccgtaaggtccggagtaacgctgcgattggagccgtttttgtggacgagaatcagtggaactccgcaaaggaagctgtagaggatgagagattctgggaccttgtgcatagggaacgcgagctgcacaaacagggcaagtgcgccacatgcgtctataatatgatgggtaaacgagaaaagaaactcggggagtttggaaaggcaaagggcagccgggccatctggtacatgtggctgggcgctagattcttggaattcgaggccctggggtttatgaacgaggatcattggttctctagggaaaattcactcagtggagtggagggtgaaggcctttacaaactggggtatatattacgcgacatctccaagattccaggaggcaacatgtacgcggatgacactgcaggttgggataccagaatcacggaggacgatctgcagaatgaggccaaaattaccgacatcatggaacccgagcacgctttgctcgccacaagcatatttaagctgacttatcaaaacaaagttgtgcgggtccagaggcctgcaaagtctgggaccgtgatggatgtaatttcgcgtcgagaccagcgcggatcaggccaggttggcacatacgggctaaacactttcaccaatatggaagtgcaacttatcagacagatggagagcgaaggaatcttttccccaagtgagctggagaactctaatctcgctgaacgggtcctggactggttggagaaacacggtgtggaaaggttaaagcgcatggccattagcggcgatgactgtgtggtcaagcccacggatgacagattcgctacagccctgaccgcactcaacgatatggggaaagttcggaaggacataccgcagtgggagccttccaaaggatggaatgattggcagcaagtgcccttttgctcacatcacttccatcagcttatcatgaaggacggcagggaaattgtagtgccatgtcgaaaccaggatgagctggtcggtcgtgcgagagtgagtcagggggccggatggtctctacgcgagactgcttgcctgggcaaaagctatgcccaaatgtggcagctcatgtactttcaccggagggacttgagactggcagctaatgccatctgttccgcagttcctgtgaactgggtccccacatcacgcaccacttggagcattcacgcccatcaccagtggatgaccacagaagatatgctttctgtgtggaatcgggtatggatcgaggaaaacccatggatggaggacaagacgcatgtttccagttgggaagacgtgccctatctgggcaagagggaggatcaatggtgcgggagcctcataggattaaccgcgcgagctacttgggccacaaatatccaggtcgcaattaaccaggtgagacggctgatcggtaatgagaactactcggactacaccacttccatgaaaaggttcaagaatgaatctgatcctgagggcgccttgtggtga

SEQ ID NO: 13215 - RNA, 9879 nt, synthetic construct
  misc_feature 1..9879: note = derived and/or modified CDS sequence (opt3) from DENV-1__JN903580__SS-prME
  source 1..9879: mol_type = other RNA
agcgtgaccatgctgctcatgcttctgcccacagcattggctttccacttaactacgagaggaggggaacctcatatgatcgtctccaagcaggaaaggggaaaatctctgttatttaagacctcagccggtgttaacatgtgcacactcattgccatggacctgggagagctttgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaggcagatccagaaagtggaaacttgggctctgcggcaccctggattcaccgttattgcactgtttctcgcccatgctatcggcacatcgattacccagaagggcatcatattcatcttactgatgcttgtgacgccatcaatggccatgcgctgcgtcgggattggaaacagagattttgtggagggtttgagcggcgcgacttgggtagacgttgtgctggagcacgggagttgtgtcacaaccatggcaaagaataaacccactttggatatcgaactcctgaagacagaggtgaccaaccctgccgtgcttaggaaactgtgcattgaagctaagatctccaatacgaccacagactctcggtgtccaactcaaggagaggccaccttggtcgaagaacaggatgcaaacttcgtttgccgccgaacatttgtggacagaggctggggtaatgggtgtggactcttcggcaaaggcagcctgttaacttgcgctaagtttaagtgcgtaaccaaactggaggggaagatagtgcagtacgaaaacctcaaatattccgtcattgtgacagttcacaccggagatcagcatcaagtgggtaatgagactacggaacacggcacaatcgccaccattactccccaggcgcctacctcagagatccagcttacagactacggggccctgaccttggactgtagtccaaggactggactagatttcaacgaaatggtcctgctcacaatgaaggagaaaagctggctggtgcataagcagtggtttcttgacctgccgttgccctggacgtctggcgcatccacctcacaagagacttggaatcggcaggatctcctggtaacattcaaaaccgctcacgccaagaagcaggaagttgtggtcttaggtagccaagagggggctatgcacacagccctgactggcgcaaccgaaatccagacgagtggaaccacaactatttttgccggccatctaaaatgccgtctcaagatggacaaactgacccttaagggggtgtcttatgtcatgtgtacaggatccttcaaattggagaaggaagtggctgagactcagcacggtaccgttctggtgcaggtaaagtacgagggcacggatgcgccttgcaaaataccattcagcacacaagacgaaaagggggtcacccagaacggacgcctcatcactgcaaatcccattgtgacagataaagagaagcctgttaacatcgaaaccgagccaccctttggcgagtcgtatatagtgattggtgccggggaaaaagctctgaaactttcttggttcaagaaaggctcctcaatcggaaagatgtttgaggccactgcaagaggcgccaggcggatggctatcctgggggacaccgcctgggatttcggaagtattggtggcgtctttacaagcgtggggaaattggtacatcaggtgttcggaacggcatacggcgttctcttttccggtgtctcttggaccatgaagatcgggattggcatactgttaacttggctgggactaaatagccgaaacacatcactcagtatgacctgtatcgcggtgggcatggtgacactgtaccttggggtcatggttcaggctgacactggatgcgtgattaactggaaaggccgcgaattgaagtgtggttccgggatcttcgtgaccaatgaggtacacacgtggacagaacaatataagtttcaggccgatagcccgaaaagactgtctgcagccatcggaaaggcttgggaggagggcgtctgcggtattaggtcagccacccggctcgaaaacataatgtggaaacagatcagtaatgagctgaaccatattttactggaaaatgacatgaagttcactgtggttgtgggcgacgcaaacgggatccttacccagggcaagaagatgattcgccctcaacccatggagcacaaatacagctggaagtcctggggcaaggctaaaatcataggggccgatacacagaatactacctttatcattgacggaccagatacacctgaatgtcccgacgatcagagagcgtggaacatctgggaggtcgaggactatggcttcggtatttttacgaccaatatctggttgaagctcagggattcttacactcagatgtgcgaccaccgtctgatgtcggccgctataaaagatagcaaggcagtgcatgccgacatggggtattggattgaatccgagaaaaacgaaacatggaagctagctcgggcctcattcatcgaggttaagacctgtatttggccacgaagtcacactctgtggtctaatggagtgctcgaaagcgagatgatcatacccaaaatctacggcggtcctatttcccaacataactatagaccaggctacttcacacagaccgcagggccgtggcacctgggaaaacttgagttggattttaatctgtgcgaaggcacgactgtagtcgtggacgagcactgcgggaacaggggaccctcattacgcaccacaaccgtgactggcaaaatcattcatgaatggtgttgccggagctgtacactccctccactgagattcaggggtgaggatgggtgctggtacggaatggagatccgccccgtcaaggaaaaagaggaaaatcttgttcgatctatggtgtccgcgggcagtggtgaggtagacagcttttctctgggcttgctctgtgtgtccataatgattgaagaggtcatgaagtcacggtggagtcgtaagatgctgatgaccgggacactagccgtgttctttctgctcatcatgggacagctgacttggaacgaccttatcagattgtgcattatggttggcgctaacgtgagcgataggatggggatgggaaccacgtatctggccttaatggcaacattcaaaatgcgccctatgtttgctgtcggcctcctgttccggagacttacctcgagggaggtgctgctactcactatcggtctgtccttggttgcctctgcagaactgccaaatagcttagaggaactcggggacggactggccatgggcattatgatgcttaagctgttgaccgattttcaatcacaccagctctggacaactctgctaagtctgaccttcataaaaacgacactttccctcgactacgcttggaagaccatcgcgatgattctgtctatcgtgagcttgtttcccctgtgtttatccactacatcacagaaaaccacttggctcccggtcctgcttggcagcttcgggtgcaagcctctgacaatgtttttgattaccgagaacaagatctggggacgaaaaagttggccactcaatgaaggtataatggccgtaggcatcgtgtctattctgctatccagcctgcttaagaacgatgttcccctcgcagggcctctgatcgctggaggcatgttgattgcctgttatgtgatctcgggttcatctgccgacttaagtctggagcgcgctgcagaggtctcctgggaagaggaagccgagcatagcggggcgtctcacaatatactcgtggaagtacaggatgacggaacgatgaaaattaaggatgaggagcgggacgatactctgaccatccttctgaaagctacattgctagccatcagcggcgtgtaccccatgtccattccagcaaccctgttcgtctggtatttctggcaaaagaaaaagcagagatcaggcgttctctgggacacacctagtcccccagaagtggagagggccgtgctggatgacgggatataccgtatccttcagcgcggattactgggtcggagccaggtcggcgtgggggtttttcaagacggagtattcagaactatgtggcatgtgaccaggggcgctgtcctcatgtatcagggtaagcgattggaaccgtcttgggcatccgtgaaaaaggatctgatttcatacgggggaggctggcggtttcagggcagttggaacacgggggaggaggttcaggtgatcgccgtcgaacctggcaagaatcccaagaacgtgcaaacaactccaggtaccttcaaaacacccgagggcgaagtaggggcgattgctctcgactttaagcctggaaccagcggctccccaatcgtcaatcgcgagggtaagatagtggggctgtacggaaacggcgttgtgactacctctggcacatatgtctcggccatcgcacaggccaaagctagccaggaagggccccttcctgagattgaggatgaagtgttcaagaaaagaaatctgacgatcatggacttgcacccgggatcaggtaagactaggcggtacctaccagccattgttcgagaggcaatcaaaagaaagctgcgcaccctcatattagctcccacaagggtggtcgcctccgaaatggcggaggccctgaagggcatgcctattcgttatcaaaccactgcagtgaaaagtgaacacacagggcgggagatcgtagatcttatgtgccatgctacctttacgatgagactgctctctccagtgagggttcccaactacaatatgatcattatggacgaggcccacttcactgatcctgctagcatcgcagcccgcggatatatatccacacgagtcggcatgggtgaagccgctgcgatttttatgaccgcaaccccgcccgggtcagtggaggccttcccacagtctaacgctgtgatccaggacgaagagagagatattcctgaacggagctggaatagtggatacgactggatcactgattttcccggcaagacagtctggttcgtaccatccataaaaagcggcaacgacattgccaactgtttgaggaagaatgggaaacgcgtgatccagctgtctcgtaagaccttcgacacagagtatcaaaagactaaaaacaatgattgggactacgttgtgacgaccgatatctcagagatgggagcaaactttagagccgaccgggtcattgatcctaggcgctgcctcaagcccgtgatcctgaaagacggtccagaacgagttattcttgctggcccgatgcctgtgacagcggcctccgcagctcagagacgggggaggataggacgcaatcagaacaaggagggcgatcagtacatctatatgggtcaacccctaaataacgacgaagatcatgcccactggactgaggcaaaaatgctgttggacaatattaacaccccagaggggatcatccccgccttattcgaacctgagagagaaaagagtgctgccattgatggcgagtacaggctgcggggagaagcgcgtaagacatttgtcgagctcatgcgccgaggcgacctgccagtgtggcttagctataaagtagcatcggaggggttccagtactctgatagaaggtggtgctttgacggagaacggaataaccaggtgctggaggaaaatatggacgttgagatatggaccaaggaaggtgagcgcaaaaagctcagacccaggtggttggatgcccggacttattccgaccctctggctctacgagagttcaaagaatttgccgctggcagacgcagcgtctcaggggatctgatcctcgagattggaaaacttccgcagcatctgacgttaagggcacaaaacgccttggacaatctggtgatgctccacaacagtgaacagggcggtaaggcttaccggcacgccatggaggaactgccagataccatcgagacacttatgctgctcgcattgattgcggtgctgactgggggcgtcaccttattctttctatctggaaagggcctggggaagacatccatcggactcctttgtgttatggccagctcagtgctgttgtggatggctagtgtagagccccattggatagccgcaagcatcattctggagttctttctcatggtgctgcttatccctgagcccgaccgtcagagaaccccacaggataaccaactcgcttatgtcgtgattggtctgttgttcatgatcctgactgttgccgcaaatgaaatgggcttactagagacaacgaaaaaggacctggggataggacacgtggtcgccgagaaccatcaccacgctaccatgctcgatattgaccttcatcctgcgtccgcctggactctgtacgcagtagctacaaccatcattacccccatgatgaggcacacaatcgaaaatactacggccaacatatctttgaccgccatcgcaaatcaggctgccattctgatgggcctcgataaaggttggccaatcagcaagatggacattggggtgcctctgcttgcgttaggctgctactcccaggttaacccgctgacactcactgctgccgtgttgatgctggtcgcacattatgccatcataggacccggcctacaagctaaagcaacccgcgaggcccagaagcggacagcggctgggattatgaagaatccaaccgtggatggaatcgtcgccatcgacctggaccctgtggtttacgatgcaaaatttgaaaagcagctcggccagattatgcttctgatcttgtgtacttcacaaatactgctcatgcgaacgacatgggccctgtgcgagtctattaccttagctactggtccccttaccacactgtgggaagggagtccaggaaaattctggaacactaccatcgccgtgtcgatggcaaatattttcagaggcagctatctcgctggtgccggcctagcgttttccctgatgaagtctctagggggaggcaggcgcgacacaggggcccagggagagacgctgggcgagaaatggaagcggcagctcaaccagctttcaaagcctgagttcaatacctacaaaagaagcggtatcatggaggtagatcgttccgaagcaaaggaggggctgaaaaggggagaaactacaaagcacgctgtgagtcggggcaccgccaaattgcgctggtttgtcgagcgaaacctggttaagcccgagggtaaggtgatagacctcggctgtgggagaggaggctggtcttattactgcgcagggctgaaaaaggtcactgaagtgaaaggatatacaaagggcggtccggggcatgaggaaccaatccctatggctacctacggatggaatattgtaaaactacacagcggcaaggatgtgttctttacgcccccagagaaatgtgacacccttctgtgcgatatcggcgaatcatcccccaaccctacaattgaggaggggaggactctacgggttctcaagatggtggaaccgtggctgcgcggaaatcaattctgtatcaagattttgaacccctacatgccaagtgtcgtggagaccctggaacagatgcagagaaaacacggtggcatgctcgtcaggaatcctcttagccgaaactctacacatgagatgtattgggtgtcctgcgggactggaaacatcgtttcagccgtaaatatgaccagccggatgctgttaaaccgttttacaatggcccacagaaagcccacctacgagcgcgacgtggatctgggcgcgggtactaggcatgtcgctgtggaacctgagatagcaaatttggacattatcgggcagcggatggaaaacatcaaaaatgagcacaagtcgacgtggcactatgatgaagacaacccatacaaaacatgggcctatcatggatcttacgaggttaagcccagtggctccgctagctcaatggtgaatggcgtcgtgagactcctgaccaagccttgggacgtaattccaatggtgactcaaatagccatgaccgatacaacgcccttcgggcagcagcgcgtttttaaagagaaggtcgacaccaggactccgcgacctaaacggggaacagcacaaatcatggaagtgaccgccaagtggctatggggtttcctttccagaaacaaaaagccaaggatttgtactcgcgaggaatttacacgtaaggtgcggtctaatgctgcgatcggcgccgtcttcgttgatgagaaccagtggaatagcgcaaaagaagctgtggaggacgagagattttgggatctggtacacagggaacgcgagctccataagcaggggaaatgcgcaacctgcgtgtataacatgatgggaaagcgagagaaaaagctgggcgagttcggtaaggccaaagggagtcgggccatttggtacatgtggttgggagctagattcctggaatttgaggccctcggcttcatgaatgaggaccactggttttccagggaaaacagcctttctggcgtcgagggggaaggactgtacaagttaggttatatcctgcgcgatatatcaaaaatccccggcgggaatatgtacgcggacgatacagcaggatgggacactagaattaccgaggatgacttgcagaacgaggccaagatcacggatattatggaacctgagcatgctctcctggccaccagtatcttcaaactaacatatcaaaacaaggtggttcgggtgcagaggccagcaaaatccggcactgtcatggacgtgataagccgtcgagaccagcgcggttctgggcaggtaggaacctacggccttaatacatttactaacatggaagttcaactgattagacagatggagtcggaaggcatcttctcacccagcgagctcgaaaattccaacctggctgaacgggtgttggattggttagagaagcacggggtcgaaaggctgaagcgcatggccatcagtggagacgattgtgtggtgaaaccgaccgacgatagatttgctacggccctcacagcacttaatgacatgggtaaggtccggaaagatattcctcagtgggagccctctaagggctggaacgactggcagcaagttccattctgcagccaccattttcaccagctgataatgaaagatgggagggaaatcgtggtaccttgtcgaaatcaggacgagctagtgggacgtgcgagagtctcccagggcgccggttggtcactgcgcgagaccgcttgcctcgggaagagttatgcccaaatgtggcagttgatgtacttccatcggagggatctgagacttgcagctaacgccatttgttctgcagtgcccgttaattgggtgccaactagccgcacaacctggtccatccacgcccaccatcagtggatgactaccgaagacatgctgtcagtctggaaccgggtgtggattgaggaaaatccctggatggaggacaagacacacgtaagctcttgggaagatgttccttatctcggaaaaagggaggaccaatggtgcggctccttaatcggcctgacggcgcgagctacctgggccactaacatacaggtggcaatcaatcaggtcagacggttgattgggaacgagaattacagtgattacatgacaagcatgaagaggtttaaaaacgaatcggacccagagggagccctgtggtga

SEQ ID NO: 13216 - RNA, 9879 nt, synthetic construct
  misc_feature 1..9879: note = derived and/or modified CDS sequence (opt3) from DENV-1__JN903581__SS-prME
  source 1..9879: mol_type = other RNA
agcgtgaccatgctgctcatgcttctgcccaccgcattggctttccacttaactacgagaggaggggaacctcatatgatcgtctccaagcaagaaaggggaaaatctctgttgtttaagacctcagccggtgttaacatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaggcagatccagaaagtggaaacttgggctctgcggcaccctggattcaccgttattgcactgtttctcgcccatgctatcggcacatcgattacccagaagggcatcatattcatcttactgatgcttgtgacgccatcaatggccatgcgctgcgtcgggattggaaacagagattttgtggagggtttgagcggcgcgacttgggtagacgttgtgctggagcacgggagttgtgtcacaaccatggcaaagaataaacccactctagatatcgaactcctgaagacagaggtgaccaaccctgccgtgcttaggaaactgtgcattgaagctaagatctccaatacgaccacagactctcggtgtccaactcaaggagaggccaccttggtcgaagaacaggatgcaaacttcgtttgccgccgaacatttgtggacagaggctggggtaatgggtgtggactcttcggcaaaggcagcctgttaacttgcgctaagtttaagtgcgtaaccaaactggaggggaagatagtgcagtacgaaaacctcaaatattccgtcattgtgacagttcacaccggagatcagcatcaagtgggtaatgagactacggaacacggcacaatcgccaccattactccccaggcgcctacctcagagatccagcttacagactacggggccctgaccttggactgtagtccaaggactggactagatttcaacgaaatggtcctgctcacaatgaaggagaaaagctggctggtgcataagcagtggtttcttgacctgccgttgccctggacgtctggcgcatccacctcacaagagacttggaatcggcaggatctcctggtaacattcaaaaccgctcacgccaagaagcaggaagttgtggtcttaggtagccaagagggggctatgcacacagccctgactggcgcaaccgaaatccagacgagtggaaccacaactatttttgccggccatctaaaatgccgtctcaagatggacaaactgacccttaagggggtgtcttatgtcatgtgtacaggatccttcaaattggagaaggaagtggctgagactcagcacggtaccgttctggtgcaggtaaagtacgagggcacggatgcgccttgcaaaataccattcagcacacaagacgaaaagggggtcacccagaacggacgcctcatcactgcaaatcccattgtgacagataaagagaagcctgttaacatcgaaaccgagccaccctttggcgagtcgtatatagtgattggtgccggggaaaaagctctgaaactttcttggttcaagaaaggctcctcaatcggaaagatgtttgaggccactgcaagaggcgccaggcggatggctatcctgggggacaccgcctgggatttcggaagtattggtggcgtctttacaagcgtggggaaattggtacatcaggtgttcggaacggcatacggcgttctcttttccggtgtctcttggaccatgaagatcgggattggcatactgttaacttggctgggactaaatagccgaaacacatcactcagtatgacctgtatcgcggtgggcatggtgacactgtaccttggggtcatggttcaggctgacactggatgcgtgattaactggaaaggccgcgaattgaagtgtggttccgggatcttcgtgaccaatgaggtacacacgtggacagaacaatataagtttcaggccgatagcccgaaaagactgtctgcagccatcggaaaggcttgggaggagggcgtctgcggtattaggtcagccacccggctcgaaaacataatgtggaaacagatcagtaatgagctgaaccatattttactggaaaatgacatgaagttcactgtggttgtgggcgacgcaaacgggatccttacccagggcaagaagatgattcgccctcaacccatggagcacaaatacagctggaagtcctggggcaaggctaaaatcataggggccgatacacagaatactacctttatcattgacggaccagatacacctgaatgtcccgacgatcagagagcgtggaacatctgggaggtcgaggactatggcttcggtatttttacgaccaatatctggttgaagctcagggattcttacactcagatgtgcgaccaccgtctgatgtcggccgtgataaaagatagcaaggctgttcatgcagacatggggtattggattgaatccgagaaaaacgaaacatggaagctagcccgggcttcattcatcgaggtgaagacctgtatttggccacgaagtcacactctgtggtctaatggagtactcgaaagcgagatgatcatacccaaaatctacggcggtcctatttcccaacataactatagaccaggctacttcacacagaccgccgggccgtggcacctgggaaaacttgagttggattttaatctgtgcgaaggcacgactgtcgtggtggacgagcactgcgggaacaggggaccctcattacgcaccacaaccgtcactggcaaaatcattcatgaatggtgttgccggagctgtacactccctccactgagattcaggggtgaggatgggtgctggtacggaatggagatccgccccgttaaggaagaggaagagaatcttgtgcgatctatggtatccgcaggcagtggtgaagtggacagcttttctctgggcttgctctgtgtctccataatgattgaggaggtgatgaaatcacggtggagtcgtaagatgctgatgaccgggacactagcggttttctttctgctcatcatgggacagctgacttggaacgaccttatcagattgtgcattatggtgggcgccaacgtcagcgataggatggggatgggaaccacgtatctggctttaatggccacattcaagatgcgccctatgtttgcagtgggcctcctgttccggagacttacctcgagggaagttctgctactcactatcggtctgtccttggtggcttctgccgagctgccaaatagcttagaagaactcggggacggactggcaatgggcattatgatgcttaaactgttggccgattttcaatcacaccagctctggaccacactgctaagtctgactttcataaagaccacgctttccctcgactacgcttggaaaacaatcgcgatgattctgtctatcgtcagcttgtttcccctgtgtttatccaccacttcacagaagacaacctggctcccggtactgcttggcagcttcgggtgcaaacctctgactatgtttttgattacagaaaacaagatctggggacgaaagagttggccactcaatgagggtataatggccgtgggcatcgtttctattctgctatccagcctgcttaaaaacgatgtgcccctcgcagggcctctgatcgctggaggcatgttgattgcctgttatgtcatctcgggttcatctgccgacttaagtctggagcgcgctgcagaagtgtcctgggaggaagaggccgaacatagcggggcgtctcacaatatactcgtagaggtgcaggatgacggaaccatgaagattaaagatgaggaacgggacgatacgctgactatccttctgaaggctaccttgctagccatcagcggcgtctaccccatgtccattccagcaacactgttcgtttggtatttctggcagaagaagaaacagagatcaggcgtgctctgggacacccctagtcccccagaggtggaaagggccgtcctggatgacgggatataccgtatccttcagcgcggattactgggtcggagccaggtgggcgttggggtatttcaagacggagtgttccatacaatgtggcacgtcactagaggcgctgtgctcatgtatcagggtaagaggttggagccgtcttgggcatccgttaagaaagatctgatttcatacgggggaggctggcgatttcagggcagttggaacaccggggaggaagtgcaggtcatcgccgtggagcctggaaagaatcccaaaaacgtacaaacgacaccaggtactttcaagacccccgaaggcgaggtcggggcgattgctctcgactttaaacctggaacaagcggctccccaatcgtgaatcgggaaggtaagatagttgggctgtacggagatggcgtggtcaccacttctggcacctatgtgtcggccatcgcacaggccaaggctagccaggaggggccccttcctgagattgaagacgaggttttcaaaaagcgcaacctgacaatcatggatttgcacccgggatcaggtaaaacgagaaggtacctaccagccattgtgcgggaagcaatcaagcgaaaactgagaactctcatattagctcccacccgcgtcgtggcctccgagatggcggaagccctgaagggcatgcctattaggtatcaaacaaccgcagtaaagagtgagcatactgggcgtgagatcgtggaccttatgtgccacgctacatttaccatgcggctgctctctccagttagagtccccaattacaacatgatcattatggatgaagcccatttcacggaccctgctagcatcgcagccaggggatatatatccactcgcgtgggcatgggtgaggccgctgcgatttttatgacagcaaccccgcccgggtcagtggaagccttcccacagtctaatgctgtcatccaggatgaggaacgagacattcctgagagaagctggaacagtggatacgattggatcaccgactttcccggcaaaactgtatggttcgtgccatccataaagagcggcaatgacattgccaactgtttgcggaaaaacgggaagagggttatccagctgtctcgcaaaacattcgataccgagtatcaaaagacaaagaataacgactgggattacgtggtcactacggacatctcagaaatgggagcaaattttcgtgccgatagagtgattgaccctcggaggtgcctcgagcccgttatcctgaaagatggtccagaacgcgtgattcttgctggcccgatgcctgtcaccgcggcctccgcagctcagcgaagagggcggataggaaggaaccagaataaggagggcgaccagtacatctatatgggtcaacccctaaacaatgatgaggaccacgcccattggacagaagcaaaaatgctgttggataacattaatactccagaggggatcatccccgccttattcgaacctgagcgcgaaaagagtgctgccattgacggcgagtacagactgaggggagaggcgcggaaaacctttgtggaactcatgcgtcgcggcgatctgccagtatggcttagctataaggtggcatcggaggggttccagtactctgaccgaagatggtgctttgacggagaaaggaacaatcaggttctggaggaaaacatggatgtcgagatatggacaaaggagggtgaacggaaaaagctccgccccagatggttggacgccaggacctattccgatcctctggctctacgggagttcaaagaatttgccgctggccgaagaagcgtgtcaggggacctgatcctcgagattggaaaacttccgcagcacctgactttacgcgcacaaaatgccttggataacctggtgatgctccacaatagtgaacagggcggtaaggcttacaggcatgccatggaggagctgccagacacgatcgaaacccttatgctgctcgcattgattgcggtcctgacagggggcgttactttattctttctatctggaaagggcctggggaaaacctccatcggactcctttgtgtgatggccagctcagtactgttgtggatggctagtgtggagccccactggatagccgcaagcatcattctggagttctttctcatggtcctgcttatccctgagcccgatcggcagcgtacaccacaggacaaccaactcgcttatgtggttattggtctgttgttcatgatcctgaccgtggccgcaaacgagatgggcttactagaaactacaaagagagatctggggataggacatgtcgtagccgagaatcaccaccatgctacgatgctcgacattgatcttcaccctgcgtccgcctggaccctgtacgcagtggctactacaatcattacccccatgatgaggcataccatcgaaaacacaactgccaatatatctttgacggccatcgcaaaccaggctgccattctgatgggcctcgacaagggttggccaatcagcaaaatggatattggggttcctctgcttgcgttaggctgctactcccaggtgaatccgctgaccctcacagctgccgtcttgatgctggtggcacactatgccatcataggacccggcctacaagctaaggcaactcgcgaggcccagaaacggaccgcggctgggattatgaagaacccaacagtcgacggaatcgtggccatcgacctggatcctgttgtgtacgacgcaaaatttgaaaagcagctcggccagattatgcttctgatcttgtgtacctcacaaatactgctcatgcgaactacgtgggccctgtgcgagtctattacattagctaccggtccccttactaccctgtgggaggggagtccaggaaagttctggaatacaactatcgccgtatcgatggcaaacattttcagaggcagctatctcgctggtgccggcctagcgttttccctgatgaaatctctagggggaggcaggcgcgggaccggagcccagggcgaaacactgggtgagaagtggaaacggcagctcaatcagctttcaaagagcgagttcaacacgtacaaaagatccgggatcatggaggtggatcgtagtgaagcaaaggagggactgaagaggggcgagaccactaaacatgctgtctctcggggtacagttaagttgcgctggtttgtggaacgaaatctggtcaaacctgagggcaaggtgatagacctcgggtgtggaagaggcgggtggagctattactgcgccggactgaaaaaggtaaccgaagtgaagggctatactaaaggtgggcccggacacgaggaaccgatcccaatggcaacatacggctggaacattgttaagctacactcaggcaaagatgtgttctttacccctcccgagaagtgtgacacgcttctgtgcgatatcggggagtccagtccaaatcccaccattgaagagggaaggacactacgggtcctcaaaatggtggaaccttggctgcgcggtaaccaattctgtatcaagattttgaatccgtacatgcccagcgtcgtggagactctggagcagatgcagagaaaacatggcgggatgctcgttaggaacccactttctcgaaattccacccacgaaatgtattgggtatcatgcggaacaggcaacatcgtgagcgctgtcaacatgacttcgcggatgctgttaaatcgttttaccatggcccatagaaagcctacatacgagcgcgacgtggatctgggtgccgggaccaggcacgttgcggtggaacccgagatagctaacttggacattatcggacagcggatcgaaaatattaagaacgagcacaaatctacttggcattatgatgaggacaatccttacaagacgtgggcatatcacggcagttacgaagtcaaaccatccggcagcgcctcatccatggtgaacggggtagtgagactcctgacaaagccctgggacgttatacctatggtcacccaaatcgctatgactgataccacaccattcggacagcagcgcgtgtttaaagagaaggtggacacgaggacaccccgaccgaagcggggtactgcccaaattatggaagtcacagcaaaatggctatggggcttcctttctagaaataagaaacctaggatctgtacccgcgaggaatttactcgtaaggttcggagcaacgccgctattggggcggtgttcgtagatgagaatcagtggaacagtgccaaagaggcagtggaagacgagagattttgggatctggtccatagggaacgcgagctccacaagcagggaaagtgcgctacatgcgtgtataatatgatgggcaaacgagaaaagaaactgggtgagttcgggaaggccaaaggatcccgggcaatctggtacatgtggttgggcgccagattcctggagtttgaagctctcggcttcatgaacgaggaccattggtttagcagggaaaattctctttcaggggttgagggagagggtctgtacaagttaggctatatactgcgcgatatcagtaagattccagggggaaacatgtacgccgacgataccgcgggctgggacacaagaatcactgaagatgacttgcagaatgaggcaaaaattaccgatatcatggaacccgagcacgccctcctggctacgtccatattcaagctaacctatcaaaacaaagtggtccgggtgcagaggcctgccaagagcggtacagtaatggacgttatttctcgtcgagaccagcgcgggtcgggacaggtgggcacttacggccttaacacctttacaaatatggaagtccaactgatcagacagatggagtcagaggggatcttcagcccatccgaactcgagaacagtaatctggcagaacgggtgttggattggttagagaaacacggagtggaaaggctgaagcgcatggctatttctggtgacgattgtgtcgttaaacccactgacgatagatttgccaccgctctcacggcccttaacgacatgggcaaggtgcggaaggatataccgcagtgggagcctagcaaagggtggaatgactggcagcaagtacccttctgctcccatcactttcatcagctgatcatgaaggatggaagggagattgtggtcccatgtcgaaaccaggacgagttagtgggccgtgcaagagtttcacagggtgcggggtggagtctgcgcgagacagcctgcctcggaaaatcttatgctcaaatgtggcagttgatgtacttccaccggagggatctgagacttgccgcaaatgctatctgtagcgccgtgcctgtcaactgggtgcccacctcccgcactacatggtcaattcacgcacatcaccagtggatgaccactgaagacatgctgagcgtatggaatcgggtttggatcgaggaaaacccatggatggaggacaagacccatgtgtcttcctgggaggatgtcccctatctcggcaaaagggaagaccaatggtgcggcagtttaatagggctgacagcccgagcgacgtgggctaccaatatccaggtggccattaaccaggttagacggttgatcggaaatgagaactacagcgattacatgacttcgatgaagaggtttaagaatgaatccgaccctgagggtgcactgtggtga

SEQ ID NO: 13217 - RNA, 9879 nt, synthetic construct
  misc_feature 1..9879: note = derived and/or modified CDS sequence (opt3) from DENV-1__KX380796__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaggcagatgcagaaagtggaaacttgggctctgcggcaccctggattcaccgttatcgcactgtttctcgcccatgctattggcacatcgatcacccagaagggcattatcttcatattactgatgcttgtgacgccatcaatggccatgcgctgcgtcgggatcggaaacagagattttgtggagggtttgagcggcgcgacttgggtagacgttgtgctggagcacgggagttgtgtcacaaccatggcaaagaataaacccactctagatattgaactcctgaagacagaggtgaccaaccctgccgtgcttaggaaactgtgcatcgaagctaagatttccaatacgaccacagactctcggtgtccaactcaaggagaggccaccttggtcgaagagcaggatgcaaacttcgtttgccgccgaacatttgtggacagaggctggggtaatgggtgtggactcttcggcaaaggcagcctgttaacttgcgctaagtttaagtgcgtaaccaaactggaggggaagacagtgcagtacgaaaacctcaaatattccgtcatcgtgaccgttcacactggagatcagcatcaagtgggtaatgagacgacagaacacggcaccatagccactattaccccccaggcgcctacatcagagatccagcttaccgactacggggccctgactttggactgtagtccaaggacaggactagatttcaacgaaatggtcctgctcacgatgaaggagaaaagctggctggtgcataagcagtggtttcttgacctgccgttgccctggacctctggcgcatccacttcacaagagacatggaatcggcaggatctcctggtaaccttcaaaacagctcacgccaagaagcaggaagttgtggtcttaggtagccaagagggggctatgcacactgccctgaccggcgcaacggaaattcagaccagtggaacaactaccatctttgccggccatctaaaatgccgtctcaagatggacaaactgacacttaagggggtgtcttatgtcatgtgtactggatccttcaaattggagaaggaagtggctgagacccagcacggtacggttctggtgcaggtaaagtacgagggcacagatgcgccttgcaaaatcccattcagcacccaagacgaaaagggggtcactcagaacggacgcctcattacagcaaatcccatagtgaccgataaagagaagcctgttaacatcgaaactgagccaccctttggcgagtcgtatattgtgatcggtgccggggaaaaagctctgaagctttcttggttcaagaaaggctcctcaataggaaagatgtttgaggccaccgcaagaggcgccaggcggatggctattctgggggacacagcctgggatttcggaagtatcggtggcgtctttacgagcgtggggaaattggtacatcaggtgttcggaaccgcatacggcgttctctttaatggtgtctcctggactatgaagatcgggattggcatcctgttaacatggctgggactaaactctcgaagcacctcactcagtatgacatgtattgcggtgggcatggtgactctgtaccttggggtcatggttcaggctgactccggatgcgtgataaactggaaaggccgcgaattgaagtgtggtagcgggatcttcgtgaccaatgaggtacacacgtggacagaacaatataagtttcaggccgattctccgaaaagactgtcagcagccattggaaaggcttgggaggagggcgtctgcggtatcaggagtgccacccggctcgaaaacatcatgtggaaacagattagcaatgagctgaaccatatattactggaaaatgacatgaagttcactgtggttgtgggcgacgcaaacgggatccttacccagggaaaaaagatgattcgccctcaacccatggagcacaaatactcctggaagtcttggggcaaggctaaaatcattggggccgatacacagaatactacctttatcatagacggaccagatacacctgaatgtcccgacgatcagagagcgtggaacatctgggaggtcgaggactatggcttcggtgtgtttacgaccaatatttggttgaagctcagggattcgtacactcagatgtgcgaccaccgtctgatgagcgccgctatcaaagattccaaggcagttcatgccgacatggggtattggattgaatcagagaaaaacgaaacatggaagctagctcgggccagtttcatcgaggtgaagacctgtatatggccacgatctcacactctgtggagcaatggagtactcgaatccgagatgattatccccaaaatttacggcggtcctatctcacaacataactatagaccaggctacttcacacagaccgcagggccgtggcacctgggaaagcttgagttggattttgacctgtgcgaaggcacgactgtcgtggtggatgagcactgcgggaataggggacccagcttacgcaccacaaccgtcactggcaaaataatccatgaatggtgttgccggtcttgtacactccctccactgagattcaggggtgaggacgggtgctggtacggaatggagattcgccccgttaaggaaaaagaggaaaaccttgtgcgatccatggtaagtgcgggcagcggtgaggtggactctttttccctgggcttgctctgtgtctcaatcatgattgaagaggtgatgcggagtcgttggagcagaaagatgctgatgaccgggacactagccgttttctttctgctcatcatgggacagctgacttggaatgatcttataaggttgtgcattatggtgggcgctaacgtctcggaccgcatggggatgggaaccacgtatctggccttaatggcaacattcaagatgcggcctatgtttgctgtgggcctcctgttcagaaggcttacctcccgagaggttctgctactcactatcggtctgtctttggtggccagcgtcgaactgccaaactcattagaggaactcggggatggactggcaatgggcatcatgatgcttaaactgttgaccgactttcaaccccaccagctctggacaactctgctaagtctgaccttcattaagacgacactttccctcgattacgcctggaaaaccatggctatggtactgtctatcgtgagcttgtttccgctgtgtttatccactacatcacagaagaccacttggctccctgttctgcttggcagcttcgggtgcaaaccactgacaatgtttttgattaccgagaataagatatggggacgcaagagttggcccctcaacgaaggtatcatggcggtgggcattgtctctatcctgctatccagcctgcttaaaaatgacgtgcctctcgccgggcccctgattgcaggaggcatgttgatcgcttgttatgtaatatcgggttcatctgccgatttaagtctggagcgggccgctgaggtgtcctgggaagaggaagcagagcatagcggggcctctcacaacatcctcgtcgaagttcaggacgatggaacgatgaagattaaagacgaggagagagatgacactctgaccatccttctgaaggcgacattgctagctgtgagcggcgtgtacccaatgtccattcctgccaccctgttcgtctggtatttctggcaaaaaaagaaacagaggtcaggcgtgctctgggatacacccagtccaccggaagttgagcgtgcagtactggacgacgggatctaccgcatacttcagcggggattactgggtagaagccaggtgggcgtcggggtgtttcaagatggagttttccatactatgtggcacgtgaccaggggcgccgtcctcatgtatcagggtaagcgattggaaccttcttgggcttccgtgaagaaagacctgatttcatacgggggaggctggcggtttcagggcagttggaatacgggggaggaggtacaggtcatcgcagtggaacccggaaagaacccaaaaaatgttcaaacaactcccggtaccttcaagacacctgagggcgaagtgggggccatcgcgctcgattttaaaccaggaaccagcggctcccccattgtcaaccgcgagggtaagatagtggggctgtacggaaatggcgttgtgactacctctggcacatatgtctcggctatcgcccaggcaaaggccagccaggaagggcctcttccggagattgaggacgaagtgttcaaaaagagaaacctgacgatcatggatttgcacccaggatcaggtaaaactaggcggtacctacccgctattgtacgagaggccatcaagagaaaactgcgcaccctcatattagcacctacaagggtggttgcttccgaaatggccgaggcgctgaagggcatgccaatccgttatcaaaccactgccgtcaagagtgaacatacagggaaagagattgtggaccttatgtgccacgcaacctttacgatgcggctgctctctcccgtgagagtccctaattacaacatgatcattatggatgaggctcatttcactgacccggccagcatcgctgcaaggggatatatatccacacgcgtaggcatgggtgaagccgccgctatttttatgaccgcgacccccccagggtcagtggaggcattccctcagtctaatgccgttatccaggatgaagagcgagacatccccgaaagaagctggaacagtggatacgattggattactgactttccaggcaagacagtgtggttcgtcccttccatcaaaagcggcaatgacatagctaactgtttgcggaagaacgggaaaagggtgattcagctgtctcgcaagaccttcgatacagagtatcaaaagactaaaaataacgactgggattacgttgtgacgaccgacatctcagagatgggagccaattttcgtgcagatagagtcattgacccccggaggtgcctcaagccagtgatcctgaaagatggtccggaacgcgtaatacttgccggccctatgcccgtgacagctgcgtccgccgcacagcgaagagggcggattggaaggaaccagaataaggagggcgaccagtacatctatatgggtcaaccactaaacaatgatgaagaccacgctcattggactgaggccaaaatgctgttggataacatcaatacccccgaggggattatccctgcattattcgaaccagagcgcgaaaagagtgccgctattgacggcgagtacagactgaggggagaagcccggaagacatttgttgagctcatgcgtcgcggcgatctgcccgtctggcttagctataaagtggcgtcggaggggttccagtactctgaccgaagatggtgctttgacggagaaaggaacaatcaggtgctggaggaaaacatggatgtcgagatatggaccaaggaaggtgagcggaaaaagctccgccctagatggttggacgcaaggacttattccgatccgctggccctacgggagttcaaagaatttgctgccggccgaagaagcgtttcaggggacctgatcctcgagattggaaagcttccacagcacctgacgttacgcgctcaaaatgcattggataacctggtgatgctccacaatagtgaacagggcggtaaagcctacaggcatgctatggaggaactgcccgacaccatcgagacacttatgctgctcgccttgatcgcagtactgactgggggcgtgaccttattctttctatctggaaagggcctggggaagacatccattggactcctttgtgtcatggcgagctcagtgctgttgtggatggccagtgttgagcctcactggatagctgccagcatcattctggaattctttctcatggtgctgcttatccccgagccagatcggcagcgtacccctcaggacaaccaactcgcatatgtcgtaattggtctgttgttcatgatcctgactgtggctgccaacgaaatgggcttactagagacaacgaaaaaggatctggggataggacatgttgtggcagagaatcaccaccatgccaccatgctcgacatcgatcttcaccccgcttccgcgtggactctgtacgccgtcgcaacaaccattatcaccccaatgatgagacatacaattgaaaacactacggctaatatctctttgaccgccatagccaaccaggcagctattctgatgggcctcgacaaaggttggcctatcagcaagatggatattggggtgccgctgcttgccttaggctgctactcccaggtcaatcccctgacactcactgcggctgtgttgatgctggttgcccactatgcaatcataggaccaggcctacaagccaaagctaccagggaggcacagaagcgcacagccgcggggatcatgaagaaccctaccgtggacggaattgtagctatcgacctggatcccgtggtctacgacgccaaatttgaaaagcagctcggccagattatgcttctgatcttgtgtacttcacaaatactgctcatgcggacgacatgggcactgtgcgagtctattaccttagccactggtccacttaccacactgtgggaagggagtcctggacgattctggaatactaccatcgctgtttcgatggccaacatcttcagaggcagctatctcgcaggtgctggcctagccttttccctgatgaaatctttggggggaggcaggcgcgggacaggagcgcagggcgagacgctgggtgagaagtggaaacggcagctcaatcagctttcaaagagcgaattcaacacctacaagagatccgggattatggaggtggatcgtagtgaagccaaagagggactgaagaggggcgaaactacaaaacatgcagtctctcggggtaccgctaagttgcgctggtttgtggagcgaaatctggtaaaacccgagggcaaggtgatcgacctcgggtgtggaagaggcgggtggagctattactgcgccggattaaagaaagttactgaagtgaagggctatacaaaaggtgggccgggacacgaggaaccaatacctatggcaacctacggctggaacattgtcaagctgcactcaggcagggatgtgttctttacgcccccagagaaatgtgacacccttctgtgcgatatcggggaatccagtcccaatcctacaattgaggagggacggactctacgcgtcctcaagatggtggaaccgtggctgagaggtaaccaattctgtatcaaaatattgaatccctacatgccaagcgttgtagagaccctggaacagatgcagaggaagcatggcgggatgctcgtgcgaaaccctctttctcggaattccacacacgagatgtattgggtctcatgcggaactggcaacatcgtgagcgctgttaacatgacctcgcgtatgctgttaaatagatttacaatggcccatcgcaagcccacctacgagagggacgtggatctgggtgccgggactcggcacgtcgcggtggaacctgagattgctaacttggacatcattggacagagaatcgaaaatattaaaaacgagcacaagtctacgtggcattatgatgaagacaatccatacaaaacatgggcatatcacggcagttacgaggtaaagccctccggcagcgcctcatccatggtgaacggggttgtccgcctcctgaccaaaccttgggacgtgatcccaatggtgactcaaatagctatgaccgatacaacgcccttcggacagcagagggtctttaaggagaaggttgacacccgaactccgcggcctaaaagaggtacagcccaaattatggaagtgaccgcaaagtggctatggggcttcctttctaggaataaaaagccacgcatctgtactcgtgaggaatttacacggaaagtaagaagcaacgccgctatcggggcggtgttcgtcgatgagaatcagtggaacagtgccaaggaagcagtggaggacgagaggttttgggatctggttcatcgcgaacgagagctccacaagcagggaaaatgcgctacctgcgtgtataatatgatgggcaagcgggaaaaaaagctgggtgagttcgggaaagccaagggatccagagcaatttggtacatgtggttgggcgccaggttcctggaatttgaggctctcggcttcatgaacgaggaccattggtttagccgcgaaaattctctttcaggggtcgagggagaaggtctgcacaagttaggctacatactgagagatatcagtaaaattcccgggggaaacatgtatgccgacgatacagcgggctgggacactcggatcaccgaggatgacttgcagaatgaggcaaagattacggatatcatggaacctgagcacgccctcctggctacctccatattcaaactaacataccaaaacaaggtggtaagggttcagcgtccagccaaaagcggtactgtgatggacgtcatctctcgacgcgaccagagagggtcgggacaggtgggcacctatggccttaacacatttactaatatggaagtgcaactgattcggcagatggagtcagaagggatcttcagcccctccgagctcgagaacagtaatctggcagaaagggtcttggattggttagagaagcatggagttgaacgcctgaaaagaatggctatttctggtgacgattgtgtggtaaagccgaccgacgatcggtttgccacggctctcacagcccttaacgacatgggcaaggtgaggaaagatatccctcagtgggagcccagcaaggggtggaatgactggcagcaagtcccattctgctcccaccattttcaccagctgataatgaaagatggacgagaaattgtggttccttgtcgtaaccaggacgagctagtgggcagagcacgcgtctcacagggtgcggggtggagtctgcgggagaccgcctgcctcggaaagtcttacgctcaaatgtggcagttgatgtatttccacaggagagatctgcgccttgccgcaaatgctatctgtagcgccgtgcccgtaaactgggttccaacttcccggacaacctggtcaatccatgcacaccatcagtggatgactaccgaagacatgctgagcgtgtggaatagggtctggattgaggaaaacccctggatggaggacaaaacacacgtgtcttcctgggaagatgttccttacctcggcaagcgagaggaccaatggtgcggcagtttaatagggctgacggccagagcgacctgggctactaatatccaggtggccattaaccaggtccggaggttgatcggaaatgagaactatctggattacatgacaagcatgaagcgctttaaaaatgaatcggacccagagggtgcactctggtga

SEQ ID NO: 13218 - RNA, 9879 nt, synthetic construct
  misc_feature 1..9879: note = derived and/or modified CDS sequence (opt3) from DENV-1__KX380799__SS-prME
  source 1..9879: mol_type = other RNA
agcgtgaccatgctgctcatgcttctgcccaccgcattggctttccacttaactacgagaggaggggaacctcatatgatcgtctccaagcaagaaaggggaaaatctctgttgtttaagacctcagccggtgttaacatgtgcacactcattgcaatggacctgggcgaactttgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaggcagatccagaaagtggaaacttgggctctgcggcaccctggattcaccgttattgcactgtttctcgcccatgctatcggcacatcgattacccagaagggcatcatattcatcttactgatgcttgtgacgccatcaatggccatgcgctgcgtcgggattggaaacagagattttgtggagggtttgagcggcgcgacttgggttgacgttgtgctggagcacgggagttgtgtcacaaccatggcaaagaataaacccactctagatatcgaactcctgaagacagaggtgaccaaccctgccgtgcttaggaaactgtgcattgaagctaagatctccaatacgaccacagactctcggtgtccaactcaaggagaggccaccttggtcgaagaacaggatgcaaacttcgtttgccgccgaacatttgtggacagaggctggggtaatgggtgtggactcttcggcaaaggcagcctgttaacttgcgctaagtttaagtgcgtaaccaaactggaggggaagatagtgcagtacgaaaacctcaaatattccgtcattgtgacagttcacaccggagatcagcatcaagtgggtaatgagactacggaacacggcacaatcgccaccattactccccaggcgcctacctcagagatccagcttacagactacggggccctgaccttggactgtagtccaaggactggactagatttcaacgaaatggtcctgctcacaatgaaggagaaaagctggctggtgcataagcagtggtttcttgacctgccgttgccctggacgtctggcgcatccacctcacaagagacttggaatcggcaggatctcctggtaacattcaaaaccgctcacgccaagaagcaggaagttgtggtcttaggtagccaagagggggctatgcacacagccctgactggcgcaaccgaaatccagacgagtggaaccacaactatttttgccggccatctaaaatgccgtctcaagatggacaaactgacccttaagggggtgtcttatgtcatgtgtacaggatccttcaaattggagaaggaagtggctgagactcagcacggtaccgttctggtgcaggtaaagtacgagggcacggatgcgccttgcaaaataccaatcagcacacaagacgaaaagggggtcacccagaacggacgcctcattactgcaaatcccatcgtgacagataaagagaagcctgttaacatagaaaccgagccacccttcggcgagtcgtatattgtgatcggtgccggggaaaaagctctgaaactttcttggtttaagaaaggctcctcaatcggaaagatgttcgaggccactgcaagaggcgccaggcggatggctattctgggggacaccgcctgggattttggaagtatcggtggcgtcttcacaagcgtggggaaattggtacatcaggtgtttggaacggcatacggcgttctcttctccggtgtctcttggaccatgaagattgggataggcatcctgttaacttggctgggactaaatagccgatcaacaagtctctccatgacctgtattgcggtgggcatggtgacactgtaccttggggtcatggttcaggctgacagcggatgcgtgatcaactggaaaggccgcgaattgaagtgtggttctgggatctttgtgactaacgaggtacacacctggacggaacaatataagttccaggccgattcaccgaaaagactgagtgcagccattggaaaggcttgggaggagggcgtctgcggtataaggagcgccacacggctcgaaaatatcatgtggaaacagatttccaacgagctgaatcatatcttactggaaaacgacatgaagtttaccgtggttgtgggcgacgcaaatgggattcttactcagggcaagaaaatgatccgccctcaacccatggagcacaaatactcttggaagtcgtggggcaaggctaaaataatcggggccgatacccagaacacaactttcattatcgacggaccagatacccctgaatgtcccgacgatcagagagcgtggaatatttgggaggtcgaggactatggctttggtgtgttcacaacgaacatctggttgaagctcagggatagctacacccagatgtgcgaccaccgtctgatgtccgccgctataaaagattcaaaggcagttcatgccgacatggggtattggattgaaagtgagaaaaatgaaacttggaagctagctcgggcctcttttatcgaggtgaagacatgtatttggccacgaagccacaccctgtggtccaacggagtactcgaatcagagatgatcatacccaaaatctacggcggtcctattagccaacataattatagaccaggctacttcactcagacagcagggccgtggcacctgggaaaacttgagttggatttcaacctgtgcgaaggcaccacggtcgtggtggacgagcactgcgggaataggggaccctctttacgcactaccacagtcaccggcaaaatcattcatgaatggtgttgccggtcctgtactctccctccactgagatttaggggtgaggatgggtgctggtacggaatggagatccgccccgttaaggaaaaagaggaaaaccttgtgcgaagtatggtaagcgcgggctctggtgaggtggactccttctcactgggcttgctctgtgtcagtataatgattgaagaggtgatgcggagccgttggtcgagaaagatgctgatgacagggaccctagccgtatttttcctgctcatcatgggacagctgacatggaatgaccttatcaggttgtgcattatggtgggcgctaacgtctccgatcgcatggggatgggaactacctatctggccttaatggcaacgtttaagatgcggcctatgttcgctgtgggcctcctgtttagaaggcttacatctcgagaggttctgctactcaccatcggtctgagcttggtggcctcagtcgaactgccaaacagtttagaggaactcggggacggactggcaatgggcattatgatgcttaaactgttgactgatttccaatcccaccagctctggaccacactgctatctctgacttttataaagaccacgcttagcctcgactacgcctggaaaacaatggctatggtactgtccatcgtgtcattgttccccctgtgtttaagcaccacaagtcagaagacaacctggctcccggttctgcttggctcttttgggtgcaaacctctgactatgttcttgattacagagaataagatctggggacgcaagtcctggccactcaacgaaggtattatggcggtgggcatcgtcagcatactgctatcgtcactgcttaaaaatgatgtgcccctcgccgggcctctgatcgcaggaggcatgttgattgcttgttatgtaatctctggtagttccgccgacttaagcctggagcgggccgctgaggtgtcttgggaagaggaagcagagcatagcggggcctcccacaacattctcgtcgaagttcaggatgacggaaccatgaagatcaaagatgaggagagagacgatacgctgactatacttctgaaggcgaccttgctagctgtgtcaggcgtgtaccccatgagtattccagccacactgtttgtctggtatttctggcagaagaagaaacagaggagcggcgtgctctgggacaccccttctcccccagaagttgagcgtgcagtactggatgacgggatctaccgcatccttcagcggggattactgggtagatcccaggtgggcgtcggggtgttccaagacggagtttttcatacaatgtggcacgtgactaggggcgccgtcctcatgtatcagggtaagcgattggaaccgtcatgggctagtgtgaagaaagatctgattagctacgggggaggctggcggttccagggctcctggaataccggggaggaggtacaggtcatagcagtggaacctggaaagaaccccaaaaatgttcaaacgacaccaggtacttttaagacccccgagggcgaagtgggggccatcgcgctcgacttcaaacctggaacatctggctcgccaattgtcaaccgcgagggtaagatcgtggggctgtacggaaatggcgttgtgaccactagcggcacctatgtctcagctattgcccaggcaaaggcctcccaggaagggccccttcctgagatcgaggatgaagtgtttaaaaagagaaacctgacaataatggacttgcacccgggaagtggtaaaacgaggcggtacctaccagctatcgtacgagaggccattaagagaaaactgcgcactctcatcttagcacccaccagggtggttgcttctgaaatggccgaggcgctgaagggcatgcctattcgttatcaaacaaccgccgtcaagagcgaacatactgggaaagagatcgtggatcttatgtgccacgcaacattcaccatgcggctgctctccccagtgagagtccccaattacaacatgataattatggacgaggctcattttacggatcctgcctcaatcgctgcaaggggatatatctctactcgcgtaggcatgggtgaagccgccgctattttcatgacagcgaccccgcccgggagcgtggaggcatttccacagagtaatgccgttatccaggacgaagaacgagatatacctgaaagatcctggaacagcggatacgactggattaccgatttccccggcaagactgtgtggtttgtcccatctatcaaatcaggcaatgacattgctaactgtttgcggaagaacgggaaaagggtgatccagctgtcccgcaagacattcgacaccgagtatcaaaagactaagaataacgattgggactacgttgtgactacggatataagtgagatgggagccaatttccgtgcagacagagtcattgatcctcggaggtgcctcaagcccgtgatcctgaaagacggtccagaacgcgtaatccttgccggcccgatgcctgtgaccgctgcgagcgccgcacagcgaagagggcggattggaaggaaccagaataaggagggcgatcagtacatctatatgggtcaacccctaaacaatgacgaagatcacgctcattggacagaggccaaaatgctgttggacaacattaatactccagaggggataatccccgcattatttgaacctgagcgcgaaaagtcggccgctattgatggcgagtacagactgaggggagaagcccggaagaccttcgttgagctcatgcgtcgcggcgacctgccagtctggctttcttataaagtggcgtccgaggggtttcagtacagcgatcgaagatggtgcttcgacggagaaaggaacaatcaggtgctggaggaaaacatggacgtcgagatctggacaaaggaaggtgagcggaaaaagctccgccccagatggttggatgcaaggacctattcagaccctctggccctacgggagtttaaagagttcgctgccggccgaagaagtgtttctggggatctgatcctcgagattggaaaacttccgcagcacctgactttacgcgctcaaaatgcattggacaacctggtgatgctccacaattccgaacagggcggtaaagcctacaggcatgctatggaggaactgccagatacgatagagacccttatgctgctcgccttgatcgcagtactgacagggggcgtgactttatttttcctaagcggaaagggcctggggaagacctcaattggactcctttgtgtcatggcgagtagcgtgctgttgtggatggcctccgttgagccccactggatcgctgcctctattatcctggaatttttcctcatggtgctgcttatacctgagcccgaccggcagcgtacaccacaggataaccaactcgcatatgtcgtaatcggtctgttgtttatgattctgaccgtggctgccaacgaaatgggcttactagagactactaaaaaggacctggggatcggacatgttgtggcagagaatcaccaccatgccacgatgctcgatattgaccttcaccctgctagcgcgtggaccctgtacgccgtcgcaactacaatcataacccccatgatgagacataccattgaaaacacaactgctaatatctccttgacggccattgccaaccaggcagctatcctgatgggcctcgataaaggttggccaatatcaaagatggacatcggggtgcctctgcttgccttaggctgctactctcaggtcaatccgctgaccctcacagcggctgtgttgatgctggttgcccactatgcaattatcggacccggcctacaagccaaagctactagggaggcacagaagcgcaccgccgcggggattatgaagaacccaacagtggatggaatcgtagctatagacctggaccctgtggtctacgatgccaaattcgaaaagcagctcggccagattatgcttctgatcttgtgtaccagtcaaatcctgctcatgcggactacgtgggcactgtgcgagtcgattacattagccaccggtccccttactaccctgtgggaagggagcccaggacgattttggaatacaactatcgctgtttccatggccaacatattcagaggctcttatctcgccggtgctggcctagccttctcactgatgaaaagcctagggggaggcaggcgcgggaccggagcgcagggcgagacactgggtgagaagtggaagcggcagctcaatcagctttccaagagtgaatttaacacgtacaagagatctgggattatggaggtggaccgtagcgaagccaaagagggactgaagaggggcgaaaccactaaacatgcagtctcacggggtacagctaagttgcgctggttcgtggagcgaaatctggtaaaacctgagggcaaggtgatcgatctcgggtgtggaagaggcgggtggtcctattactgcgccggattaaagaaagttaccgaagtgaagggctatactaaaggtgggcccggacacgaggaaccgattccaatggcaacatacggctggaacatcgtcaagctgcacagtggcagggacgtgtttttcacccctcccgagaaatgtgatacgcttctgtgcgacataggggaaagctctccaaatcccaccatcgaggagggacggacactacgcgtcctcaagatggtggaaccttggctgagaggtaaccaattttgtattaaaatcttgaatccgtacatgccctccgttgtagagactctggaacagatgcagaggaagcatggcgggatgctcgtgcgaaacccactttcacggaatagcacccacgagatgtattgggtctcgtgcggaacaggcaacattgtgtctgctgttaacatgacaagtcgtatgctgttaaatagattcaccatggcccatcgcaagcctacatacgagagggatgtggacctgggtgccgggacccggcacgtcgcggtggaacccgagatcgctaacttggatattatcggacagagaatagaaaatattaaaaacgagcacaagtccacttggcattatgacgaagataatccttacaaaacgtgggcatatcacggcagctacgaggtaaagccatcaggctccgcctctagcatggtgaacggggttgtccgcctcctgacaaaaccctgggacgtgatccctatggtgacccaaatcgctatgactgacaccacaccatttggacagcagagggtcttcaaggagaaggttgatacgcgaacaccccggccgaaaagaggtactgcccaaattatggaagtgacagcaaagtggctatggggctttcttagtaggaataaaaagcctcgcatatgtacccgtgaggagttcactcggaaagtaagatccaacgccgctatcggggcggtgtttgtcgacgagaatcagtggaacagcgccaaggaagcagtggaggatgagaggttctgggacctggttcatcgcgaacgagagctccacaagcagggaaaatgcgctacatgcgtgtataatatgatgggcaagcgggagaaaaagctgggtgagtttgggaaagccaagggatctagagcaatttggtacatgtggttgggcgccaggttcctggagttcgaggctctcggctttatgaacgaggatcattggttctcacgcgaaaatagtctttccggggtcgagggagaaggtctgcacaagttaggctacatcctgagagacattagcaaaatcccagggggaaacatgtatgccgatgacaccgcgggctgggatacacggataactgaggacgatttgcagaatgaggcaaagatcaccgacattatggaacccgagcacgccctcctggctacgtctatctttaaactaacctaccaaaacaaggtggtaagggttcagcgtcctgccaaatcgggtacagtgatggatgtcatttcacgacgcgaccagagagggagcggacaggtgggcacttatggccttaacaccttcacaaatatggaagtgcaactgatccggcagatggagtccgaagggatatttagtccatctgagctcgagaacagcaatctggcagaaagggtcttggactggttagagaagcatggagttgaacgcctgaaaagaatggctatttccggtgatgactgtgtggtaaagcccactgatgaccggttcgccaccgctctcacggcccttaacgatatgggcaaggtgaggaaagacatcccgcagtgggagccttcaaaggggtggaatgattggcagcaagtccccttttgcagtcaccatttccaccagctgatcatgaaagacggacgagaaattgtggttccatgtcgtaaccaggatgagctagtgggcagagcacgcgtctctcagggtgcggggtggagcctgcgggagacagcctgcctcggaaagtcctacgctcaaatgtggcagttgatgtattttcacaggagagacctgcgccttgccgcaaatgctatatgttcagccgtgcctgtaaactgggttcccaccagccggactacatggtctatccatgcacaccatcagtggatgaccactgaagatatgctgtccgtgtggaatagggtctggattgaggaaaacccatggatggaggacaaaacccacgtgagtagctgggaagacgttccctacctcggcaagcgagaggatcaatggtgcggctcgttaatcgggctgacagccagagcgacgtgggctaccaatattcaggtggccatcaaccaggtccggaggttgataggaaatgagaactatctggactacatgacttccatgaagcgcttcaaaaatgaatctgatcctgagggtgcactctggtga

SEQ ID NO: 13219 - RNA, 9879 nt, synthetic construct
  misc_feature 1..9879: note = derived and/or modified CDS sequence (opt3) from DENV-1__KX380800__SS-prME
  source 1..9879: mol_type = other RNA
agcgtgaccatgctgctcatgcttctgcccaccgcattggctttccacttaactacgagaggaggggaacctcatatgatcgtctccaagcaagaaaggggaaaatctctgttatttaagacctcagccggtgttaacatgtgcacactcattgcaatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaggcagatccagaaagtggaaacttgggctctgcggcaccctggattcaccgttattgcactgtttctcgcccatgctatcggcacatcgattacccagaagggcatcatattcatcttactgatgcttgtgacgccatcaatggccatgcgctgcgtcgggattggaaacagagattttgtggagggtttgagcggcgcgacttgggtagacgttgtgctggagcacgggagttgtgtcacaaccatggcaaagaataaacccactttggatatcgaactcctgaagacagaggtgaccaaccctgccgtgcttaggaaactgtgcattgaagctaagatctccaatacgaccacagactctcggtgtccaactcaaggagaggccaccttggtcgaagaacaggatgcaaacttcgtttgccgccgaacatttgtggacagaggctggggtaatgggtgtggactcttcggcaaaggcagcctgttaacttgcgctaagtttaagtgcgtaaccaaactggaggggaagatagtgcagtacgaaaacctcaaatattccgtcattgtgacagttcacaccggagatcagcatcaagtgggtaatgagactacggaacacggcacaatcgccaccattactccccaggcgcctacctcagagatccagcttacagactacggggccctgaccttggactgtagtccaaggactggactagatttcaacgaaatggtcctgctcacaatgaaggagaaaagctggctggtgcataagcagtggtttcttgacctgccgttgccctggacgtctggcgcatccacctcacaagagacttggaatcggcaggatctcctggtaacattcaaaaccgctcacgccaagaagcaggaagttgtggtcttaggtagccaagagggggctatgcacacagccctgactggcgcaaccgaaatccagacgagtggaaccacaactatttttgccggccatctaaaatgccgtctcaagatggacaaactgacccttaagggggtgtcttatgtcatgtgtacaggatccttcaaattggagaaggaagtggctgagactcagcacggtaccgttctggtgcaggtaaagtacgagggcacggatgcgccttgcaaaataccaatcagcacacaagacgaaaagggggtcacccagaacggacgcctcattactgcaaatcccatcgtgacagataaagagaagcctgttaacatagaaaccgagccacccttcggcgagtcgtatattgtgatcggtgccggggaaaaagctctgaaactttcttggtttaagaaaggctcctcaatcggaaagatgttcgaggccactgcaagaggcgccaggcggatggctattctgggggacaccgcctgggattttggaagtatcggtggcgtcttcacaagcgtggggaaattggtacatcaggtgtttggaacggcatacggcgttctcttctccggtgtctcttggaccatgaagattgggataggcatcctgttaacttggctgggactaaatagccgatcaacaagtctctccatgacctgtattgcggtgggcatggtgacactgtaccttggggtcatggttcaggctgacagcggatgcgtgatcaactggaaaggccgcgaattgaagtgtggttctgggatctttgtgactaacgaggtacacacctggacggaacaatataagttccaggccgattcaccgaaaagactgagtgcagccattggaaaggcttgggaggagggcgtctgcggtataaggagcgccacacggctcgaaaatatcatgtggaaacagatttccaacgagctgaatcatatcttactggaaaacgacatgaagtttaccgtggttgtgggcgacgcaaatgggattcttactcagggcaagaagatgatccgccctcaacccatggagcacaaatactcttggaagtcgtggggcaaggctaaaataatcggggccgatacccagaacacaactttcattatcgacggaccagatacccctgaatgtcccgacgatcagagagcgtggaatatttgggaggtcgaggactatggctttggtgtgttcacaacgaacatctggttgaagctcagggatagctacacccagatgtgcgaccaccgtctgatgtccgccgctataaaagattcaaaggcagttcatgccgacatggggtattggattgaaagtgagaaaaatgaaacttggaagctagctcgggcctcttttatcgaggtgaagacatgtatttggccacgaagccacaccctgtggtccaacggagtactcgaatcagagatgatcatacccaaaatctacggcggtcctattagccaacataattatagaccaggctacttcactcagacagcagggccgtggcacctgggaaaacttgagttggatttcaacctgtgcgaaggcaccacggtcgtggtggacgagcactgcgggaataggggaccctctttacgcactaccacagtcaccggcaaaatcattcatgaatggtgttgccggtcctgtactctccctccactgagatttaggggtgaggatgggtgctggtacggaatggagatccgccccgttaaggaaaaagaggaaaaccttgtgcgaagtatggtaagcgcgggctctggtgaggtggactccttctcactgggcttgctctgtgtcagtataatgattgaagaggtgatgcggagccgttggtcgagaaagatgctgatgacagggaccctagccatctttttcctgctcatcatgggacagctgacatggaatgaccttattaggttgtgcatcatggttggcgctaacgtgtccgatcgcatggggatgggaactacctatctggccttaatggcaacgtttaagatgcggcctatgttcgctgtcggcctcctgtttagaaggcttacatctcgagaggtgctgctactcaccattggtctgagcttggttgcctcagtggaactgccaaacagtttagaggaactcggggacggactggcaatgggcataatgatgcttaaactgttgactgatttccaatcccaccagctctggaccacactgctatctctgacttttatcaagaccacgcttagcctcgactacgcctggaaaacaatggctatggtcctgtccattgtatcattgttccccctgtgtttaagcaccacaagtcagaagacaacctggctcccggtgctgcttggctcttttgggtgcaaacctctgactatgttcttgatcacagagaataagatttggggacgcaagtcctggccactcaacgaaggtatcatggcggttggcatagtgagcatcctgctatcgtcactgcttaaaaatgatgtccccctcgccgggcctctgattgcaggaggcatgttgatcgcttgttatgtgatttctggtagttccgccgacttaagcctggagcgggccgctgaggtatcttgggaagaggaagcagagcatagcggggcctcccacaacatcctcgtggaagtccaggatgacggaaccatgaagataaaagatgaggagagagacgatacgctgactattcttctgaaggcgaccttgctagctgtttcaggcgtgtaccccatgagtatcccagccacactgtttgtgtggtatttctggcagaagaagaaacagaggagcggcgtcctctgggacaccccttctcccccagaagtggagcgtgcagttctggatgacgggatctaccgcattcttcagcggggattactgggtagatcccaggtaggcgtgggggtcttccaagacggagtgtttcatacaatgtggcacgttactaggggcgccgtgctcatgtatcagggtaagcgattggaaccgtcatgggctagtgtcaagaaagatctgataagctacgggggaggctggcggttccagggctcctggaataccggggaggaggtgcaggtaatcgcagtcgaacctggaaagaaccccaaaaatgtgcaaacgacaccaggtacttttaagacccccgagggcgaagttggggccattgcgctcgacttcaaacctggaacatctggctcgccaatcgtgaaccgcgagggtaagattgtcgggctgtacggaaatggcgtggttaccactagcggcacctatgtgtcagctatcgcccaggcaaaggcctcccaggaagggccccttcctgagatagaggatgaagtctttaaaaagagaaacctgacaatcatggacttgcacccgggaagtggtaaaacgaggcggtacctaccagctattgtgcgagaggccatcaagagaaaactgcgcactctcattttagcacccaccagggtagtggcttctgaaatggccgaggcgctgaagggcatgcctatccgttatcaaacaaccgccgttaagagcgaacatactgggaaagagatagtcgatcttatgtgccacgcaacattcaccatgcggctgctctccccagtgagagtgcccaattacaacatgattatcatggacgaggctcattttacggatcctgcctcaatcgctgcaaggggatatatttctactcgcgtcggcatgggtgaagccgccgctatcttcatgacagcgaccccgcccgggagcgtagaggcatttccacagagtaatgccgtgatacaggacgaagaacgagatattcctgaaagatcctggaacagcggatacgactggatcaccgatttccccggcaagactgtttggtttgtgccatctattaaatcaggcaatgacatcgctaactgtttgcggaagaacgggaaaagggtcatacagctgtcccgcaagacattcgacaccgagtatcaaaagactaagaataacgattgggactacgtggttactacggatattagtgagatgggagccaatttccgtgcagacagagtgatcgatcctcggaggtgcctcaagcccgtcatcctgaaagacggtccagaacgcgtgattcttgccggcccgatgcctgtaaccgctgcgagcgccgcacagcgaagagggcggatcggaaggaaccagaataaggagggcgatcagtacatttatatgggtcaacccctaaacaatgacgaagatcacgctcattggacagaggccaaaatgctgttggacaacataaatactccagaggggatcattcccgcattatttgaacctgagcgcgaaaagtcggccgctatcgatggcgagtacagactgaggggagaagcccggaagaccttcgtggagctcatgcgtcgcggcgacctgccagtttggctttcttataaagtcgcgtccgaggggtttcagtacagcgatcgaagatggtgcttcgacggagaaaggaacaatcaggtgctggaggaaaacatggacgtggagatctggacaaaggaaggtgagcggaaaaagctccgccccagatggttggatgcaaggacctattcagaccctctggccctacgggagtttaaagagttcgctgccggccgaagaagtgtctctggggatctgattctcgagataggaaaacttccgcagcacctgactttacgcgctcaaaatgcattggacaacctggttatgctccacaattccgaacagggcggtaaagcctacaggcatgctatggaggaactgccagatacgatcgagacccttatgctgctcgccttgattgcagtgctgacagggggcgtaactttatttttcctaagcggaaagggcctggggaagacctcaatcggactcctttgtgtgatggcgagtagcgtcctgttgtggatggcctccgtggagccccactggattgctgcctctatcatactggaatttttcctcatggttctgcttatccctgagcccgaccggcagcgtacaccacaggataaccaactcgcatatgtggtcattggtctgttgtttatgatcctgaccgtagctgccaacgaaatgggcttactagagactactaagaaggacctggggattggacatgtggttgcagagaatcaccaccatgccacgatgctcgatatcgaccttcaccctgctagcgcgtggaccctgtacgccgtggcaactacaataattacccccatgatgagacataccatcgaaaacacaactgctaatatttccttgacggccatcgccaaccaggcagctatactgatgggcctcgataaaggttggccaatctcaaagatggacattggggtccctctgcttgccttaggctgctactctcaggtgaatccgctgaccctcacagcggctgtcttgatgctggtggcccactatgcaatcattggacccggcctacaagccaaagctactagggaggcacagaagcgcaccgccgcggggatcatgaagaacccaacagttgatggaatagtggctattgacctggaccctgtagtgtacgatgccaaattcgaaaagcagctcggccagatcatgcttctgatcttgtgtaccagtcaaattctgctcatgcggactacgtgggcactgtgcgagtcgatcacattagccaccggtccccttactaccctgtgggaagggagcccaggaaaattttggaatacaactatagctgtctccatggccaacattttccgaggctcttatctcgccggtgctggcctagccttctcactgatgaaaagcctagggggaggcagaagggggaccggagcgcagggcgagacactgggtgagaaatggaagcgccagctcaatcagctttccaagagtgaatttaacacgtacaaacggtctgggatcatggaggttgacagaagcgaagccaaggagggactgaaacgtggcgaaaccactaagcatgcagtgtcaaggggtacagctaaattgcggtggttcgtcgagcgcaatctggtgaagcctgagggcaaggtaattgatctcgggtgtggacgaggcgggtggtcctattactgcgccggactgaaaaaggtgaccgaagttaaaggctatactaagggtgggcccggacacgaggaaccgatcccaatggcaacatacggctggaacatagtgaaactacacagtggcagagacgtctttttcacccctcccgagaagtgtgatacgcttctgtgcgacatcggggaaagctctccaaatcccaccattgaggagggaaggacactacgggtgctcaaaatggtcgaaccttggctgcgcggtaaccaattttgtatcaagattttgaatccgtacatgccctccgtggttgagactctggaacagatgcagagaaagcatggcgggatgctcgtaaggaacccactttcacgaaatagcacccacgagatgtattgggtgtcgtgcggaacaggcaacatcgtctctgctgtgaacatgacaagtcggatgctgttaaatcgtttcaccatggcccatagaaaacctacatacgagcgcgatgttgacctgggtgccgggaccaggcacgtggcggtcgaacccgagattgctaacttggatatcataggacagcggattgaaaatatcaagaacgagcacaaatccacttggcattatgacgaagataatccttacaagacgtgggcatatcacggcagctacgaggtgaaaccatcaggctccgcctctagcatggtaaacggggtggttagactcctgacaaagccctgggacgtcatccctatggtgacccaaattgctatgactgacaccacaccatttggacagcagcgcgtgttcaaggagaaagtcgatacgaggacaccccgaccgaagcggggtactgcccaaataatggaagttacagcaaaatggctatggggctttcttagtagaaataagaaacctaggatctgtacccgcgaggagttcactcgtaaggtgcggtccaacgccgctattggggcggtatttgtggacgagaatcagtggaacagcgccaaggaagcagtcgaggatgagagattctgggacctggtgcatagggaacgcgagctccacaaacagggaaagtgcgctacatgcgtttataatatgatgggcaaacgagaaaagaaactgggtgagtttgggaaggccaagggatctcgggcaatctggtacatgtggttgggcgccagattcctggagttcgaggctctcggctttatgaacgaggatcattggttctcaagggaaaatagtctttccggggtggagggagaaggtctgcacaaattaggctacattctgcgcgacatcagcaagataccagggggaaacatgtatgccgatgacaccgcgggctgggatacaagaatcactgaggacgatttgcagaatgaggcaaaaattaccgacatcatggaacccgagcacgccctcctggctacgtctatttttaagctaacctaccaaaacaaagtcgtgcgggtacagaggcctgccaagtcgggtacagttatggatgtgatctcacgtcgagaccagcgcgggagcggacaggtcggcacttatggccttaacaccttcacaaatatggaagtgcaactgataagacagatggagtccgaagggatttttagtccatctgagctcgagaacagcaatctggcagaacgggtgttggactggttagagaaacatggagtcgaaaggctgaagcgcatggctatctccggtgatgactgtgttgtgaagcccactgatgacagattcgccaccgctctcacggcccttaacgatatgggcaaagtacggaaggacatcccgcagtgggagccttcaaaagggtggaatgattggcagcaagtgcccttttgcagtcaccatttccaccagctgattatgaaggacggaagggaaatagtcgtgccatgtcgaaaccaggatgagctagttggccgtgcaagagtgtctcagggtgcggggtggagcctgcgcgagacagcctgcctcggaaaatcctacgctcaaatgtggcagttgatgtattttcaccggagggacctgagacttgccgcaaatgctatctgttcagccgtccctgtgaactgggtacccaccagccgcactacatggtctattcatgcacaccatcagtggatgaccactgaagatatgctgtccgtttggaatcgggtgtggatcgaggaaaacccatggatggaggacaagacccacgtcagtagctgggaagacgtgccctacctcggcaagagggaggatcaatggtgcggctcgttaattgggctgacagcccgagcgacgtgggctaccaatatccaggttgccataaaccaggtgagacggttgatcggaaatgagaactatctggactacatgacttccatgaaaaggttcaagaatgaatctgatcctgagggtgcactctggtga

SEQ ID NO: 13220 - RNA, 9879 nt, synthetic construct
  misc_feature 1..9879: note = derived and/or modified CDS sequence (opt3) from DENV-1__KX380802__SS-prME
  source 1..9879: mol_type = other RNA
agcgtgaccatgctgctcatgcttctgcccaccgcattggctttccacttaactacgaggggaggggagcctcatatgatcgtctccaagcaagaaaggggaaagtctctgttatttaagacctcagccggtgttaacatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaggcagatccagaaagtggaaacttgggctctgcggcaccctggattcaccgttattgcactgtttctcgcccatgctatcggcacatcgattacccagaagggcatcatattcatcttactgatgcttgtgacgccatcaatggccatgcgctgcgtcgggattggaaacagagattttgtggagggtttgagcggcgcgacttgggttgacgttgtgctggagcacgggagttgtgtcacaaccatggcaaagaataaacccactctagatatcgaactcctgaagacagaggtgaccaaccctgccgtgcttaggaaactgtgcattgaagctaagatctccaatacgaccacagactctcggtgtccaactcaaggagaggccaccttggtcgaagaacaggatgcaaacttcgtttgccgccgaacatttgtggacagaggctggggtaatgggtgtggactcttcggcaaaggcagcctgttaacttgcgctaagtttaagtgcgtaaccaaactggaggggaagatagtgcagtacgaaaacctcaaatattccgtcattgtgacagttcacaccggagatcagcatcaagtgggtaatgagactacggaacacggcacaatcgccaccattactccccaggcgcctacctcagagatccagcttacagactacggggccctgaccttggactgtagtccaaggactggactagatttcaacgaaatggtcctgctcacaatgaaggagaaaagctggctggtgcataagcagtggtttcttgacctgccgttgccctggacgtctggcgcatccacctcacaagagacttggaatcggcaggatctcctggtaacattcaaaaccgctcacgccaagaagcaggaagttgtggtcttaggtagccaagagggggctatgcacacagccctgactggcgcaaccgaaatccagacgagtggaaccacaactatttttgccggccatctaaaatgccgtctcaagatggggaaactgacccttaagggagtgtcttatgtcatgtgtacaggttccttcaaattggagaaggaagtggctgagactcagcacggcaccgttctggtgcaggtaaagtacgaggggacggacgcgccttgcaaaataccaatcagcacacaagatgaaaagggagtcacccagaacggccgcctcattactgcaaatcccatcgtgacagacaaagagaagcctgttaacatagaaaccgagccacccttcggtgagtcgtatattgtgatcggggccggcgaaaaagctctgaaactttcttggtttaagaaaggatcctcaatcggcaagatgttcgaggccactgcaagaggggccaggcggatggctattctgggagataccgcctgggactttggtagtatcggcggggtcttcacaagcgtgggaaaattggtacatcaggtgtttggcacggcatacggtgttctcttctccggggtctcttggaccatgaagattggcataggaatcctgttaacttggctgggcctaaatagccgatcaacaagtctctccatgacctgtattgcggtggggatggtgacactgtaccttggagtcatggttcaggctgatagcggctgcgtgatcaactggaaaggtcgcgaattgaagtgtgggtctggaatctttgtgactaacgaggtacacacctggacggaacaatataagttccaggccgactcaccgaaaagactgagtgcagccattggcaaggcttgggaggagggtgtctgcggcataaggagcgccacacggctcgaaaatatcatgtggaaacagatttccaacgagctgaatcatatcttactggaaaacgatatgaagtttaccgtggttgtgggggacgcaaatggcattcttactcagggcaaaaagatgatccgccctcaacccatggagcacaaatactcttggaagtcgtgggggaaggctaaaataatcggagccgacacccagaacacaactttcattatcgatggcccagacacccctgaatgtcccgatgaccagagagcgtggaatatttgggaggtcgaggattatggttttggggtgttcacaacgaacatctggttgaagctcagggacagctacacccagatgtgcgatcaccgtctgatgtccgccgctataaaagactcaaaggcagttcatgccgatatgggatattggattgaaagtgagaaaaatgaaacttggaagctagctcgggcctcttttatcgaggtgaagacatgtatttggccacgaagccacaccctgtggtccaacggcgtactcgaatcagagatgatcatacccaaaatctacggtggccctattagccaacataattatagaccagggtacttcactcagacagcaggaccgtggcacctgggcaaacttgagttggacttcaacctgtgcgaagggaccacggtcgtggtggatgagcactgcggaaataggggcccctctttacgcactaccacagtcaccggtaaaatcattcatgaatggtgttgccggtcctgtactctccctccactgagatttagaggggaagacggatgctggtacggcatggagatccgccccgttaaggaaaaagaggaaaaccttgtgcgaagtatggtaagcgcgggttctggcgaggtggattccttctcactggggttgctctgtgtcagtataatgattgaagaggtgatgcggagccgttggtcgagaaagatgctgatgacaggaaccctagccgtatttttcctgctcatcatgggccagctgacatggaatgaccttatcaggttgtgcattatggtgggggctaacgtctccgaccgcatgggaatgggcactacctatctggccttaatggcaacgtttaagatgcggcctatgttcgctgtgggtctcctgtttagaaggcttacatctcgagaggttctgctactcaccatcgggctgagcttggtggcctcagtcgaactgccaaacagtttagaggaactcggagatggcctggcaatgggcattatgatgcttaaactgttgactgacttccaatcccaccagctctggaccacactgctatctctgacttttataaagaccacgcttagcctcgattacgcctggaaaacaatggctatggtactgtccatcgtgtcattgttccccctgtgtttaagcaccacaagtcagaagacaacctggctcccggttctgcttgggtcttttggatgcaaacctctgactatgttcttgattacagagaataagatctggggtcgcaagtcctggccactcaacgaaggcattatggcggtggggatcgtcagcatactgctatcgtcactgcttaaaaatgacgtgcccctcgccggacctctgatcgcaggcggtatgttgattgcttgttatgtaatctctgggagttccgccgatttaagcctggagcgggccgctgaggtgtcttgggaagaggaagcagagcatagcggagcctcccacaacattctcgtcgaagttcaggacgatggcaccatgaagatcaaagacgaggagagagatgacacgctgactatacttctgaaggcgaccttgctagctgtgtcaggcgtgtaccccatgagtattccagccacactgtttgtctggtatttctggcagaagaagaaacagaggagcggggtgctctgggataccccttctcccccagaagttgagcgtgcagtactggacgatggaatctaccgcatccttcagcggggtttactgggcagatcccaggtgggggtcggagtgttccaagacggcgtttttcatacaatgtggcacgtgactaggggtgccgtcctcatgtatcaggggaagcgattggaaccgtcatgggctagtgtgaagaaagacctgattagctacggaggcggctggcggttccaggggtcctggaataccggagaggaggtacaggtcatagcagtggaacctggtaagaaccccaaaaatgttcaaacgacaccaggcacttttaagacccccgagggggaagtgggagccatcgcgctcgatttcaaacctggcacatctggttcgccaattgtcaaccgcgaggggaagatcgtgggactgtacggcaatggcgttgtgaccactagcgggacctatgtctcagctattgcccaggcaaaggcctcccaggaaggaccccttcctgagatcgaggacgaagtgtttaaaaagagaaacctgacaataatggatttgcacccgggtagtggcaaaacgaggcggtacctaccagctatcgtacgagaggccattaagagaaaactgcgcactctcatcttagcacccaccagggtggttgcttctgaaatggccgaggcgctgaaggggatgcctattcgttatcaaacaaccgccgtcaagagcgaacatactggaaaagagatcgtggaccttatgtgccacgcaacattcaccatgcggctgctctccccagtgagagtccccaattacaacatgataattatggatgaggctcattttacggaccctgcctcaatcgctgcaaggggctatatctctactcgcgtaggtatgggggaagccgccgctattttcatgacagcgaccccgcccggaagcgtggaggcatttccacagagtaatgccgttatccaggatgaagaacgagacatacctgaaagatcctggaacagcggctacgattggattaccgacttccccggcaagactgtgtggtttgtcccatctatcaaatcagggaatgatattgctaactgtttgcggaagaacggaaaaagggtgatccagctgtcccgcaagacattcgacaccgagtatcaaaagactaagaataacgactgggattacgttgtgactacggacataagtgagatgggtgccaatttccgtgcagatagagtcattgaccctcggaggtgcctcaagcccgtgatcctgaaagatggcccagaacgcgtaatccttgccgggccgatgcctgtgaccgctgcgagcgccgcacagcgaagaggacggattggcaggaaccagaataaggagggtgaccagtacatctatatggggcaacccctaaacaatgatgaagaccacgctcattggacagaggccaaaatgctgttggataacattaatactccagagggcataatccccgcattatttgaacctgagcgcgaaaagtcggccgctattgacggagagtacagactgaggggcgaagcccggaagaccttcgttgagctcatgcgtcgcggggatctgccagtctggctttcttataaagtggcgtccgagggatttcagtacagcgaccgaagatggtgcttcgatggtgaaaggaacaatcaggtgctggaggaaaacatggacgtcgagatctggacaaaggaaggcgagcggaaaaagctccgccccagatggttggacgcaaggacctattcagatcctctggccctacgggagtttaaagagttcgctgccgggcgaagaagtgtttctggagacctgatcctcgagattggcaaacttccgcagcacctgactttacgcgctcaaaatgcattggataacctggtgatgctccacaattccgaacagggtgggaaagcctacaggcatgctatggaggaactgccagacacgatagagacccttatgctgctcgccttgatcgcagtactgacaggcggagtgactttatttttcctaagcggcaaggggctgggaaagacctcaattggtctcctttgtgtcatggcgagtagcgtgctgttgtggatggcctccgttgagccccactggatcgctgcctctattatcctggaatttttcctcatggtgctgcttatacctgagcccgatcggcagcgtacaccacaggacaaccaactcgcatatgtcgtaatcggcctgttgtttatgattctgaccgtggctgccaacgaaatggggttactagagactactaagaaggatctgggaatcggccatgttgtggcagagaatcaccaccatgccacgatgctcgacattgatcttcaccctgctagcgcgtggaccctgtacgccgtcgcaactacaatcataacccccatgatgagacataccattgaaaacacaactgctaatatctccttgacggccattgccaaccaggcagctatcctgatgggtctcgacaaagggtggccaatatcaaagatggatatcggcgtgcctctgcttgccttaggatgctactctcaggtcaatccgctgaccctcacagcggctgtgttgatgctggttgcccactatgcaattatcggccccgggctacaagccaaagctactagggaggcacagaagcgcaccgccgcgggaattatgaagaacccaacagtggacggcatcgtagctatagatctggaccctgtggtctacgacgccaaattcgaaaagcagctcggtcagattatgcttctgatcttgtgtaccagtcaaatcctgctcatgcggactacgtgggcactgtgcgagtcgattacattagccaccgggccccttactaccctgtgggaaggaagcccaggcaaattttggaatacaactatcgctgtttccatggccaacatattccgaggttcttatctcgcaggcgctgggctagccttctcactgatgaaatccttgggaggcgggagaaggggaaccggcgcgcagggtgagacactgggggagaaatggaagcgccagctcaatcagcttagcaagagtgaatttaacacgtacaaacggtctggaattatggaggtggatagaagcgaagccaaggagggcctgaaacgtggtgaaaccactaagcatgcagtctcaaggggcacagctaaattgcggtggttcgtggagcgcaatctggtaaagcctgaggggaaggtgatcgacctcggatgtggccgagggggatggtcctattactgcgccggcctaaagaaggttaccgaagtgaaaggttatactaaagggggacccggccacgaggaaccgattccaatggcaacatacggctggaacatcgtcaaactgcacagtgggagagatgtgtttttcacccctcccgagaagtgtgacacgcttctgtgcgatataggagaaagctctccaaatcccaccatcgaggagggtaggacactacgggtcctcaaaatggtggaaccttggctgcgcggcaaccaattttgtattaagatcttgaatccgtacatgccctccgttgtagagactctggaacagatgcagagaaagcatgggggaatgctcgtgaggaacccactttcacgaaatagcacccacgagatgtattgggtctcgtgcggcacaggtaacattgtgtctgctgttaacatgacaagtcggatgctgttaaatcgtttcaccatggcccatagaaaacctacatacgagcgcgacgtggatctgggggccggaaccaggcacgtcgcggtggaacccgagatcgctaacttggacattatcggccagcggatagaaaatattaagaacgagcacaaatccacttggcattatgatgaagacaatccttacaagacgtgggcatatcacggcagctacgaggtaaaaccatcagggtccgcctctagcatggtgaacggagttgtcagactcctgacaaagccctgggatgtgatccctatggtgacccaaatcgctatgactgacaccacaccatttggtcagcagcgcgtcttcaaggagaaagttgacacgaggacaccccgaccgaagcggggcactgcccaaattatggaagtgacagcaaaatggctatgggggtttcttagtagaaataagaaacctaggatatgtacccgcgaggagttcactcgtaaggtacggtccaacgccgctatcggagcggtgtttgtcgatgagaatcagtggaacagcgccaaggaagcagtggaggacgagagattctgggatctggttcatagggaacgcgagctccacaaacagggcaagtgcgctacatgcgtgtataatatgatgggtaaacgagaaaagaaactgggggagtttggaaaggccaagggctctcgggcaatttggtacatgtggttgggcgccagattcctggagttcgaggctctcgggtttatgaacgaggaccattggttctcaagggaaaatagtctttccggagtcgagggtgaaggcctgcacaaattagggtacatcctgcgcgatattagcaagatcccaggaggcaacatgtatgccgacgataccgcgggttgggacacaagaataactgaggatgacttgcagaatgaggcaaaaatcaccgatattatggaacccgagcacgccctcctggctacgtctatctttaagctaacctaccaaaacaaagtggtacgggttcagaggcctgccaagtcggggacagtgatggacgtcatttcacgtcgagatcagcgcggaagcggccaggtgggcacttatgggcttaacaccttcacaaatatggaagtgcaactgatcagacagatggagtccgaaggaatatttagtccatctgagctcgagaacagcaatctggcagaacgggtcttggactggttagagaaacatggtgttgaaaggctgaagcgcatggctatttccggcgacgattgtgtggtaaagcccactgacgatagattcgccaccgctctcacggcccttaacgacatggggaaagtgcggaaggatatcccgcagtgggagccttcaaaaggatggaatgactggcagcaagtccccttttgcagtcaccatttccaccagctgatcatgaaggatggcagggaaattgtggttccatgtcgaaaccaggacgagctagtgggtcgtgcaagagtctctcagggggcgggatggagcctgcgcgagacagcctgcctcggcaaatcctacgctcaaatgtggcagttgatgtattttcaccggagggatctgagacttgccgcaaatgctatatgttcagccgtgcctgtaaactgggttcccaccagccgcactacatggtctatccatgcacaccatcagtggatgaccactgaagacatgctgtccgtgtggaatcgggtctggattgaggaaaacccatggatggaggataagacccacgtgagtagctgggaagacgttccctacctcggcaagagggaggaccaatggtgcgggtcgttaatcggactgacagcccgagcgacgtgggctaccaatattcaggtggccatcaaccaggtcagacggttgataggtaatgagaactatctggattacatgacttccatgaaaaggttcaagaatgaatctgaccctgagggcgcactctggtga

SEQ ID NO: 13221 - RNA, 9879 nt, synthetic construct
  misc_feature 1..9879: note = derived and/or modified CDS sequence (opt3) from DENV-1__KX380797__SS-prME
  source 1..9879: mol_type = other RNA
agcgtgaccgtcctgctcatgcttctgcccactgcattggctttccacttaactacgcgaggaggggaacctcatatgatcgtttccaagcaggaaaggggaaaatctctgctatttaagacctcaacaggtgtgaatatgtgcactctcattgcaatggacctgggcgaactttgtgaagataccatgacatacaaatgcccacggataaccgaaactgaaccggacgatgtagactgttggtgcaatgccacagagacctgggtgacgtatgggacttgtagtcaaaccggagagcaccgccgagataagcgtagcgtcgcgctggctccccatgtgggcttgggtctcgaaacaaggactgagacctggatgtcctctgaaggggcctggaggcagatccagaaagttgagacatgggcactgcggcaccctggattcaccgtgattgccctgtttctcgctcatgcaatcggcacgtcgattactcagaagggcatcatattcatcttactgatgcttgtcacaccatcaatggccatgcgctgcgtggggattggaaacagagactttgtagagggtttgagcggcgctacctgggttgatgtggtcctggaacacgggagttgtgtgactacaatggccaaggacaaacccaccctagatatcgagctcctgaagacggaagtgaccaatcctgcggtccttaggaaactgtgcattgaggcaaagatctccaacacaactaccgactctcggtgtccaacacaaggagaagccactttggttgaggagcaggataccaatttcgtgtgccgccgaacactcgtagaccggggctggggtaacgggtgtggactgtttggcaaaggcagcttaataacctgcgctaagttcaagtgcgtgactaaactggaagggaagattgtccagtacgagaatctcaaatattccgtgatcgttacggtgcacacaggagatcagcatcaagtcggtaacgaaaccactgagcacggcaccacagccaccattactccccaggcacctacatcagaaatccagcttacggactacggggctctgaccttggactgtagtccaaggactggactagattttaatgagatggtgctgctcacaatgaaggagaaaagctggctggtacataagcagtggttccttgacctgccgttgccctggacctctggcgcctccacatcacaagaaacttggaaccggcaggatctcctggttacctttaaaacggcgcacgccaagaagcaggaggtggtcgtgttaggtagccaagaaggggcaatgcacaccgctctgacaggcgccactgagatccagaccagtggaacaactaccattttcgctggccatctaaaatgccgtctcaagatggacaaactgacgcttaagggggtctcttatgtgatgtgtacaggatcctttaaattggaaaaggaggttgccgagacccagcacggtactgtgctggtacaggtcaagtacgaaggcacagatgcaccttgcaaaataccattcaccagccaagacgagaagggggtgactcagaatggacgcctcatcaccgccaaccccattgttacagataaagaaaagcctgtgaatatcgaggctgagccacccttcggcgaatcgtatctggtcgtgggtgcgggggagaaagcacttaagctgtcttggtttaagaaaggctcctcaataggaaagatgttcgaagccacggctagaggcgccaggcggatggcaattttgggggacaccgcctgggattttggaagtatcggtggcgtattcactagcgtggggaaactcatccatcagatttttggaacagcttacggcgttctgttctccggtgtctcttggaccatgaagatcgggattggcatattactgacatggctaggactcaacagccgatcaacaagtctgtccatgacctgtatcgccgtgggcatggtgacgctttacttgggggtcatggttcaggcagacagcggatgcgtgattaattggaaaggccgcgagctgaagtgtggttctgggatctttgtgacaaacgaagtacacacctggactgagcaatataagttccaggcggattcaccgaaaagactcagtgctgccatcggaaaggcatgggaggaaggcgtctgcggtattaggagcgccacccggctggagaacataatgtggaaacagatctccaatgaattaaaccatattctgcttgagaatgacatgaagtttacagtggttgtgggcgacgtcaacgggatcttggctcagggcaagaaaatgattcgccctcaacccatggaacacaaatactcttggaagtcgtggggcaaggccaaagtgatcggggcagatgttcagaatagcactttcataatcgacggaccaaacacccctgagtgtcccgatgaccagagagcttggaatatttgggaggtggaagattatggctttggtatcttcacaacgaacatttggctcaagctgagggactcctacacccaggtatgcgatcaccgtctaatgtcagccgcgatcaaagacagtaaggccgtccatgctgatatggggtattggatagagtctgagaagaatgagacttggaagctgacacgggccagctttattgaagtgaagacctgtgtgtggccaaaatcccacactctctggtcaaacggagtcctggagagcgagatgatcattcccaagatctacggcggtcctatatctcaacataattatcgaccaggctacttcacacagaccgccgggccgtggcaccttggaaaattggaactggacttcggcttatgcgaggggacgactgttgtggtagatgaacactgcggaaacagaggcccctccctcaggaccacaaccgtgactggtaagatcattcatgagtggtgttgccgcagttgtacactgcctccacttcggtttaaaggggaggacggatgctggtacggcatggaaatcagacccgtcaaggagaaggaagagaatctggtgaaaagcatggtttctgctggttccggcgaagtggattcattcagtttggggctcctgtgtattagcatcatgatagaggaggtcatgaggtcgcgctggtcccgaaagatgctaatgaccggaacactggccgtgtttctcctgcttattatgggccagttgacttggaacgacctgatccggttatgcatcatggttggggcaaatgcgtctgacaaaatgggaatgggcaccacgtatctcgccctgatggctacattccgtatgagacctatgtttgccgtgggtcttctgttcaggcgcctaaccagccgggaagtcctcctgagatcagtagggttgagtctggtggcatccgttgagttaccaaactctctcgaagaactgggagatggccttgctatgggcattatgatgctgaagttgctcactgactttcaaagccaccagctgtgggccgcactactgtcccttaccttcgtgaaaacaactttttcactccattacgcctggaagaccatggctatgatcctgagcattgtcagtttgttccccctgtgtttatctacgacatcccagaagaccacttggctcccggtgctgcttgggagcctgggatgcaaacctttgacaatgtttctcataaccgaaaacaagatctggggtaggaaatcgtggccactgaatgagggcattatggcggtagggatcgtgtcaattctactgtctagtcttctcaagaacgatgtccccctggccggacctttgatcgcaggcggtatgttaatagcttgttatgttatctccgggagctctgccgacctgagcctcgagaaagccgctgaagtgtcctgggaggaagaggcagaacactcaggagccagtcataatattctggtggaggtccaggatgacggcactatgaagatcaaagatgaggaacgagacgatacacttaccattctgttgaaggcgacgctactggctatcagcggcgtgtaccccatgtctataccagccactctcttcgtttggtatttttggcaaaagaaaaagcagcgctccggggtactgtgggacaccccttcacccccagaggtggaacgggcagtccttgatgacggaatttacagaatcttacagaggggtctgctcggcaaaagtcaggtgggggttggagtgttccaagagggcgtcttccacacaatgtggcacgtgacccgtggtgccgtattgatgtatcaggggaagcgcctggagccgagctgggcttccgtcaaaaaggatctcatctcttacggaggcggctggcggtttcaggggtcgtggaacacaggagaagaggtgcaggttattgcagtggaacctggtaagaatcccaaaaacgtccaaactgccccaggcaccttcaagacgcccgagggggaagtgggagcgatagctctggactttaaacctggcacaagcggttcaccaatcgttaatagagaggggaagattgtgggactttacggcaacggcgtcgtgactacctccgggacatatgtaagtgccatcgcacaggccaaggcttctcaggagggacccctgcctgaaattgaggacgaagtgttcaggaagcgaaatttgaccatcatggatctacatccgggtagcggcaagactcggcgctacctgccagccatagttagagaggcaatcaaaaggaagctccggaccttagtcctggctcccacacgagtggtggcctccgaaatggcggaggcccttaaagggatgcctattagatatcaaacgactgcagtcaagtcagagcacaccggaaaagaaatcgtagacctgatgtgccatgctacatttaccatgcgcctcttgtctccagtgagggttcccaactacaatatgattatcatggatgaggcccacttcactgaccctgctagcatagcagcccgtggctatattagtacacgggtgggtatgggggaagccgctgcgatctttatgaccgcaacgccgcccggatccatggaggccttcccacagagcaacgctgccatccaggatgaagagagagacattcctgagaggtcttggaactcaggctacgattggatcactgactttcccggcaagacagtctggttcgtgccatccataaagagtgggaacgatattgcaaattgtctgcgcaaaaacggaaagcgagttgtgcagctcagcagaaaaacctttgacaccgaatatcaaaagactaaaaacaatgattgggactacgtcgtgacaaccgacatctcggagatgggtgccaacttccgggctgatagggtaattgaccctcgccgttgcctgaagcccgtgatccttaaggatggcccagaaagagttatactagcggggccgatgcctgtcacagtggcctctgcagctcagcggaggggacgcattggccgaaatcagaacaaagagggtgaccagtacatctatatggggcaacccctgaataacgatgaggaccatgcccactggactgaagcaaagatgttgttagataatatcaacacgccagagggcattatccccgccctgttcgaacctgagagagaaaaatccgctgccattgacggagagtaccggctcaggggcgaggcgcgcaagacctttgtggaactgatgagaagaggggatcttccagtctggctgagctataaagttgcatcagagggattccagtacagtgaccggcgttggtgctttgatggtgaacgcaataaccaggtgctcgaggaaaatatggacgtagagatatggacaaaggagggcgaaaggaaaaagttgagacccagatggctggatgcccggacttattctgaccctctagctctgcgcgagttcaaggaatttgccgctgggagaaggtccgtgagcggagacctcatccttgagattggcaaactgccgcagcacttaacccaacgggcacagaacgccttggataatctggtcatgctccataactcagaacagggtgggaaggcttaccgacacgccatggaggagctgccagacacaatcgaaacccttatgctgctcgcattgatcgcggtgctgactggcggagttacgttattctttctaagtggcagagggctgggaaaaaccagcattggtctcctttgtgtgatggcctcctctgctctgttgtggatggccagcgtcgagccccattggatagcagcttccatcattctggagttctttctcatggtactgcttatccctgagcccgatcgccagaggacaccacaagacaatcagctcgcctatgtggttattggcctgttgttcatgatcctgactgtggcagccaacgagatggggttactagaaaccacaaagaaagatctgggaataggccacgtcgctgcggagtcacaccatcacgccgcaatgctcgacgtggatcttcatcctgcttctgcctggaccctgtacgccgtcgcaactacaatcattacgcccatgatgcggcacaccatcgaaaacactacagctaatattagtttgaccgccatcgcgaaccaggctgccatactgatgggtctcgacaaggggtggccaatttcgaagatggatatcggcgtgcctctgcttgcattaggatgctacagccaagttaatccgctgaccctcacagccgctgtgttgatgctggtagcacattatgccattatcggccccgggctacaggcgaaagctactcgtgaggcccagaagagaacggcagccggaataatgaaaaacccaaccgtggacggcatcgtcgctattgatctggaccctgttgtgtacgatgccaagtttgaaaaacagctcggtcaaatcatgcttctgattttgtgtacatcccagatcctgctcatgaggactacctgggcactgtgcgagtctataacattagctaccgggccccttactacgctgtgggagggatcaccaggcaagttctggaatacaaccattgccgtcagcatggcgaacatctttcgcggttcctatctcgccggcgcagggctagctttcagtctgatgaagtctttgggaggcgggcggcgaggaactggcgcccagggtgaaaccctgggggagaaatggaagagacagctcaatcaacttacaaaaagcgagttcaacacttacaagaggtcaggaatcattgaggtggaccgctccgaagcaaaagagggcctgaagcggggtgagaccacaaagcacgctgtaagtagaggcacggccaaattgcgttggtttgtggaaaggaatctggttaagcctgaggggaaagtgatcgacctcggatgtggcagagggggatggagctattactgcgccggcttaaagaaagtcaccgaagtgaagggttatactaaagggggacccggccacgaggaaccgataccaatggcgacatacggctggaacctggtcaaactttactctgggaaggatgtgttctttacccctcccgagaaatgtgacactctgctatgcgatattggagagtcctcaccaaatcccacaatcgaagagggtcgcaccctccgagttctgaagatggtagaaccttggttgagaggcaaccagttctgtattaaagtgctgaatccgtatatgcccagcgtcgtggagacgctcgagcagatgcagaggaagcatgggggaatgcttgttcggaacccactgtcgcgcaattctacccacgaaatgtactgggtgagttgcggcacaggtaacatcgtctccgctgtgaatatgactagcagaatgttactgaacaggtttaccatggcacatcgaaaacctacatatgagcgggacgtagatttgggggccggaactcgtcacgtggctgttgaacccgaggtcgccaacctcgacataatcggccaaagaattgaaaatatcaagaacgagcacaagtcaacctggcattacgatgaggacaatccttataaaacatgggcataccacggctcctatgaagtgaagccatctgggagcgccagttccatggtgaacggagtcgttcgcctgctaaccaaaccctgggatgtgattcctatggtaactcagatcgctatgacggacacaaccccattcggtcagcaaagggtgtttaaggagaaagtcgatactcggacccccaaggcgaagagaggcacagcccagattatggaagtgacggcacgctggctttgggggttcctgagcaggaataaaaagccgcgaatctgtacccgggaggaatttactagaaaagttaggtctaacgctgccataggagcagtgttcgtcgacgagaatcagtggaactcagccaaggaggctgtggaagacgagcgcttttgggatctcgtacatcgtgaacgggagctgcacaaacagggcaagtgcgccacatgcgtttacaatatgatgggtaagagagagaaaaagttgggggagttcggaaaagcgaagggcagtagggcaatttggtacatgtggctgggcgcccgctttctcgagttcgaagctcttgggttcatgaacgaggaccattggttttcccgagaaaatagcctgtctggagtggagggtgagggcttacacaaactggggtatatcttgcgggatatctcgaagattcctggaggcaacatgtacgccgacgataccgcaggttgggacactagaataacagaagatgacctccaaaatgaggctaaaatcaccgatattatggaaccagagcacgccctgctagctacatcaatcttcaaacttacttatcagaacaaggtcgtgagggtgcagcgccccgccaaaaatgggaccgtcatggacgttattagcagacgggatcagaggggatccggccaagtgggcacgtacgggctgaacacctttacaaacatggaagcacagctcatccgtcagatggagagtgagggaatattcctgccttctgaattggagactccaaatttagcggaacgagtactggactggctcgagaagtatggtatcgaacgccttaaaagaatggccattagcggcgatgactgtgtggtcaagcccgtggacgatcggtttgctaccgccctgacagcactaaacgacatggggaaagttaggaaggatatcccgcagtgggagccttccaagggatggaatgactggcaacaggtgcccttctgctcacatcactttcatcagctgattatgaaagatggccgcgagatcgtcgtgccatgtagaaaccaggacgaactcgtaggtcgggctagggttagtcaaggggccggatggtctttgcgagagactgcatgcctgggcaagagctacgcccagatgtggcagcttatgtatttccaccgtagagatctgcgcctcgcggctaatgccatatgttccgcagtgcctgtcgactgggtgcccacctcacggacgacatggagcattcacgcccatcaccaatggatgaccactgaagatatgttatctgtttggaacagggtgtggatcgaggaaaatccatggatggaggacaaaacacatgtctccagttgggaggatgtgccctacctgggcaagagagaagaccagtggtgcgggagcttgatcggactgaccgctcgcgccacttgggcaaccaacattcaggtagctataaatcaggtgcggaggctcatcggtaacgagaattaccttgactatatgacatcgatgaaacgatttaagaacgaatccgatcctgagggcgccctgtggtga

SEQ ID NO: 13222 - RNA, 9879 nt, synthetic construct
  misc_feature 1..9879: note = derived and/or modified CDS sequence (opt3) from DENV-1__KX380805__SS-prME
  source 1..9879: mol_type = other RNA
agcgtgacaatgctgctcatgcttctgcccacagcattggctttccacttaactacgagaggaggggaacctcatatgatcgtctccaagcaagaaaggggaaaatctctgttatttaagacctcagccggtgttaacatgtgcacactcattgcaatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagacaagcgttccgtggccctggcaccccatgtcggcttgggtctcgagactagaaccgaaacatggatgtcctctgagggggcctggaggcagatccagaaagtggaaacttgggctctgcggcaccctggattcaccgttattgcactgtttctcgcccatgctatcggcacatcgattacccagaagggcatcatattcatcttactgatgcttgtgacgccatcaatggccatgcgctgcgtcgggattggaaacagagattttgtggagggtttgagcggcgcgacttgggttgacgttgtgctggagcacgggagttgtgtcacaaccatggcaaagaataaacccactttggatatcgaactcctgaagacagaggtgaccaaccctgccgtgcttaggaaactgtgcattgaagctaagatctccaatacgaccacagactctcggtgtccaactcaaggagaggccaccttggtcgaagaacaggatgcaaacttcgtttgccgccgaacatttgtggacagaggctggggtaatgggtgtggactcttcggcaaaggcagcctgttaacttgcgctaagtttaagtgcgtaaccaaactggaggggaagatagtgcagtacgaaaacctcaaatattccgtcattgtgacagttcacaccggagatcagcatcaagtgggtaatgagactacggaacacggcacaatcgccaccattactccccaggcgcctacctcagagatccagcttacagactacggggccctgaccttggactgtagtccaaggactggactagatttcaacgaaatggtcctgctcacaatgaaggagaaaagctggctggtgcataagcagtggtttcttgacctgccgttgccctggacgtctggcgcatccacctcacaagagacttggaatcggcaggatctcctggtaacattcaaaaccgctcacgccaagaagcaggaagttgtggtcttaggtagccaagagggggctatgcacacagccctgactggcgcaaccgaaatccagacgagtggaaccacaactatttttgccggccatctaaaatgccgtctcaagatggacaaactgacccttaagggggtgtcttatgtcatgtgtacaggatccttcaaattggagaaggaagtggctgagactcagcacggtaccgttctggtgcaggtaaagtacgagggcacggatgcgccttgcaaaataccaatcagcacacaagacgaaaagggggtcacccagaacggacgcctcattactgcaaatcccatcgtgacagataaagagaagcctgttaacatagaaaccgagccacccttcggcgagtcgtatattgtgatcggtgccggggaaaaagctctgaaactttcttggtttaagaaaggctcctcaatcggaaagatgttcgaggccactgcaagaggcgccaggcggatggctattctgggggacaccgcctgggattttggaagtatcggtggcgtcttcacaagcgtggggaaattggtacatcaggtgtttggaacggcatacggcgttctcttctccggtgtctcttggaccatgaagattgggataggcatcctgttaacttggctgggactaaatagccgatcaacaagtctctccatgacctgtattgcggtgggcatggtgacactgtaccttggggtcatggttcaggctgacagcggatgcgtgatcaactggaaaggccgcgaattgaagtgtggttctgggatctttgtgactaacgaggtacacacctggacggaacaatataagttccaggccgattcaccgaaaagactgagtgcagccattggaaaggcttgggaggagggcgtctgcggtataaggagcgccacacggctcgaaaatatcatgtggaaacagatttccaacgagctgaatcatatcttactggaaaacgacatgaagtttaccgtggttgtgggcgacgcaaatgggattcttactcagggcaagaagatgatccgccctcaacccatggagcacaaatactcttggaagtcgtggggcaaggctaaaataatcggggccgatacccagaacacaactttcattatcgacggaccagatacccctgaatgtcccgacgatcagagagcgtggaatatttgggaggtcgaggactatggctttggtgtgttcacaacgaacatctggttgaagctcagggatagctacacccagatgtgcgaccaccgtctgatgtccgccgctataaaagattcaaaggcagttcatgccgacatggggtattggattgaaagtgagaaaaatgaaacttggaagctagctcgggcctcttttatcgaggtgaagacatgtatttggccacgaagccacaccctgtggtccaacggagtactcgaatcagagatgatcatacccaaaatctacggcggtcctattagccaacataattatagaccaggctacttcactcagacagcagggccgtggcacctgggaaaacttgagttggatttcaacctgtgcgaaggcaccacggtcgtggtggacgagcactgcgggaataggggaccctctttacgcactaccacagtcaccggcaaaatcattcatgaatggtgttgccggtcctgtactctccctccactgagatttaggggtgaggatgggtgctggtacggaatggagatccgccccgttaaggaaaaagaggaaaaccttgtgcgaagtatggtaagcgcgggctctggtgaggtggactccttctcactgggcttgctcagtgtcagcataatgattgaagaggtgatgcggtcgcgttggtccagaaagatgctgatgacagggaccctagccgtatttttcctgctcatcatgggacagctgacatggaatgaccttatcaggttgtgtattatggtgggcgctaacgtctctgatcgcatggggatgggaactacctatctggccttaatggcaacgtttaagatgcggcctatgttcgctgtgggcctcctgtttagaaggcttacaagccgagaggttctgctactcaccatcggtctgtcattggtggccagtgtcgaactgccaaactccttagaggaactcggggacggactggcaatgggcattatgatgcttaaactgttgactgatttccaatctcaccagctctggaccacactgctaagcctgacttttataaagaccacgctttccctcgactacgcctggaaaacaatggctatggtactgtcaatcgtgagcttgttccccctgtgcttaagtaccacttctcagaagacaacctggctcccggttctgcttggctcctttgggtgtaaacctctgactatgttcttgattacagagaataagatctggggacgcaagagctggccactcaacgaaggtattatggcggtgggcatcgtctcgatactgctatcatctctgcttaaaaatgatgtgcccctcgccgggcctctgatcgcaggaggcatgttgattgcttgctatgtaatcagtggttccagcgccgacttatctctggagcgggccgctgaggtgagctgggaagaggaagcagagcattccggggcctcacacaacattctcgtcgaagttcaggatgacggaaccatgaagatcaaagatgaggagagagacgatacgctgactatacttctgaaggcgaccttgctagctgtgagtggcgtgtaccccatgagcattccagccacactgtttgtctggtatttctggcagaagaagaaacagaggtctggcgtgctctgggacaccccttcacccccagaagttgagcgtgcagtactggatgacgggatctaccgcatccttcagcggggattactgggtagaagccaggtgggcgtcggggtgttccaagacggagtttttcatacaatgtggcacgtgactaggggcgccgtcctcatgtatcagggtaagcgattggaaccgagttgggctagcgtgaagaaagatctgatttcctacgggggaggctggcggttccagggctcttggaataccggggaggaggtacaggtcatagcagtggaacctggaaagaaccccaaaaatgttcaaacgacaccaggtacttttaagacccccgagggcgaagtgggggccatcgcgctcgacttcaaacctggaacatcgggcagcccaattgtcaaccgcgagggtaagatcgtggggctgtacggaaatggcgttgtgaccacttcaggcacctatgtctccgctattgcccaggcaaaggccagtcaggaagggccccttcctgagatcgaggatgaagtgtttaaaaagagaaacctgacaataatggacttgcacccgggatctggtaaaacgaggcggtacctaccagctatcgtacgagaggccattaagagaaaactgcgcactctcatcttagcacccaccagggtggttgctagcgaaatggccgaggcgctgaagggcatgcctattcgttatcaaacaaccgccgtcaagtccgaacatactgggaaagagatcgtggatcttatgtgtcacgcaacattcaccatgcggctgctctcaccagtgagagtccccaattacaacatgataattatggacgaggctcattttacggatcctgcctctatcgctgcaaggggatatatcagcactcgcgtaggcatgggtgaagccgccgctattttcatgacagcgaccccgcccgggagtgtggaggcatttccacagtccaatgccgttatccaggacgaagaacgagatatacctgaaagaagctggaactctggatacgactggattaccgatttccccggcaagactgtgtggtttgtcccatcaatcaaatccggcaatgacattgctaactgcttgcggaagaacgggaaaagggtgatccagctgagtcgcaagacattcgacaccgagtatcaaaagaccaagaataacgattgggactacgttgtgactacggatataagcgagatgggagccaatttccgtgcagacagagtcattgatcctcggaggtgtctcaagcccgtgatcctgaaagacggtccagaacgcgtaatccttgccggcccgatgcctgtgaccgctgcgtcggccgcacagcgaagagggcggattggaaggaaccagaataaggagggcgatcagtacatctatatgggtcaacccctaaacaatgacgaagatcacgctcattggacagaggccaaaatgctgttggacaacattaatactccagaggggataatccccgcattatttgaacctgagcgcgaaaagtctgccgctattgatggcgagtacagactgaggggagaagcccggaagaccttcgttgagctcatgcgtcgcggcgacctgccagtctggctttcctataaagtggcgagcgaggggtttcagtactcagatcgaagatggtgcttcgacggagaaaggaacaatcaggtgctggaggaaaacatggacgtcgagatctggacaaaggaaggtgagcggaaaaagctccgccccagatggttggatgcaaggacctatagtgaccctctggccctacgggagtttaaagagttcgctgccggccgaagatctgtttccggggatctgatcctcgagattggaaaacttccgcagcacctgactttacgcgctcaaaatgcattggacaacctggtgatgctccacaatagcgaacagggcggtaaagcctacaggcatgctatggaggaactgccagatacgatagagacccttatgctgctcgccttgatcgcagtactgacagggggcgtgactttatttttcctatcaggaaagggcctggggaagaccagtattggactcctttgcgtcatggcgagctccgtgctgttgtggatggcctctgttgagccccactggatcgctgccagcattatcctggaatttttcctcatggtgctgcttatacctgagcccgaccggcagcgtacaccacaggataaccaactcgcatatgtcgtaatcggtctgttgtttatgattctgaccgtggctgccaacgaaatgggcttactagagactaccaaaaaggacctggggatcggacatgttgtggcagagaatcaccaccatgccacgatgctcgatattgaccttcaccctgcttccgcgtggaccctgtacgccgtcgcaactacaatcataacccccatgatgagacataccattgaaaacacaactgctaatatctcattgacggccattgccaaccaggcagctatcctgatgggcctcgataaaggttggccaatatctaagatggacatcggggtgcctctgcttgccttaggctgttacagtcaggtcaatccgctgaccctcacagcggctgtgttgatgctggttgcccactatgcaattatcggacccggcctacaagccaaagctactagggaggcacagaagcgcaccgccgcggggattatgaagaacccaacagtggatggaatcgtagctatagacctggaccctgtggtctacgatgccaaattcgaaaagcagctcggccagattatgcttctgatcttgtgcacctcgcaaatcctgctcatgcggactacgtgggcactgtgtgagagcattacattagccaccggtccccttactaccctgtgggaagggtccccaggaaaattttggaatacaactatcgctgtttctatggccaacatattccgaggctcatatctcgccggtgctggcctagccttcagcctgatgaagtccctagggggaggcagaagggggaccggagcgcagggcgagacactgggtgagaaatggaagcgccagctcaatcagcttagtaagtctgaatttaacacgtacaaacggagcgggattatggaggtggacagatcagaagccaaggagggactgaaacgtggcgaaaccactaagcatgcagtctccaggggtacagctaaattgcggtggttcgtggagcgcaatctggtaaagcctgagggcaaggtgatcgatctcgggtgcggacgaggcgggtggagttattactgtgccggactgaaaaaggttaccgaagtgaaaggctatactaagggtgggcccggacacgaggaaccgattccaatggcaacatacggctggaacatcgtcaaactacacagcggcagagacgtgtttttcacccctcccgagaagtgcgatacgcttctgtgtgacataggggaatcttccccaaatcccaccatcgaggagggaaggacactacgggtcctcaaaatggtggaaccttggctgcgcggtaaccaattttgcattaagatcttgaatccgtacatgccctcagttgtagagactctggaacagatgcagagaaagcatggcgggatgctcgtgaggaacccacttagccgaaattcgacccacgagatgtattgggtctcttgtggaacaggcaacattgtgagtgctgttaacatgacttcccggatgctgttaaatcgtttcaccatggcccatagaaaacctacatacgagcgcgatgtggacctgggtgccgggaccaggcacgtcgcggtggaacccgagatcgctaacttggatattatcggacagcggatagaaaatattaagaacgagcacaaaagcacttggcattatgacgaagataatccttacaagacgtgggcatatcacggctcatacgaggtaaaaccatccggctctgccagcagtatggtgaacggggttgtcagactcctgacaaagccctgggacgtgatccctatggtgacccaaatcgctatgactgacaccacaccatttggacagcagcgcgtcttcaaggagaaagttgatacgaggacaccccgaccgaagcggggtactgcccaaattatggaagtgacagcaaaatggctatggggctttctttccagaaataagaaacctaggatatgcacccgcgaggagttcactcgtaaggtacggagcaacgccgctatcggggcggtgtttgtcgacgagaatcagtggaactctgccaaggaagcagtggaggatgagagattctgggacctggttcatagggaacgcgagctccacaaacagggaaagtgtgctacatgcgtgtataatatgatgggcaaacgagaaaagaaactgggtgagtttgggaaggccaagggatcacgggcaatttggtacatgtggttgggcgccagattcctggagttcgaggctctcggctttatgaacgaggatcattggttcagtagggaaaattcccttagcggggtcgagggagaaggtctgcacaaattaggctacatcctgcgcgacatttctaagatcccagggggaaacatgtatgccgatgacaccgcgggctgggatacaagaataactgaggacgatttgcagaatgaggcaaaaatcaccgacattatggaacccgagcacgccctcctggctacgtcgatctttaagctaacctaccaaaacaaagtggtacgggttcagaggcctgccaagtcaggtacagtgatggatgtcattagccgtcgagaccagcgcgggtccggacaggtgggcacttatggccttaacaccttcacaaatatggaagtgcaactgatcagacagatggagagtgaagggatattttctccaagcgagctcgagaactccaatctggcagaacgggtcttggactggttagagaaacatggagttgaaaggctgaagcgcatggctatttcaggtgatgactgcgtggtaaagcccactgatgacagattcgccaccgctctcacggcccttaacgatatgggcaaagtgcggaaggacatcccgcagtgggagcctagtaaagggtggaatgattggcagcaagtccccttttgttctcaccatttccaccagctgatcatgaaggacggaagggaaattgtggttccatgccgaaaccaggatgagctagtgggccgtgcaagagtcagccagggtgcggggtggtccctgcgcgagacagcctgtctcggaaaatcatacgctcaaatgtggcagttgatgtattttcaccggagggacctgagacttgccgcaaatgctatatgcagcgccgtgcctgtaaactgggttcccacctctcgcactacatggtccatccatgcacaccatcagtggatgaccactgaagatatgctgagtgtgtggaatcgggtctggattgaggaaaacccatggatggaggacaagacccacgtgagctcgtgggaagacgttccctacctcggcaagagggaggatcaatggtgtggctccttaatcgggctgacagcccgagcgacgtgggctaccaatattcaggtggccatcaaccaggtcagacggttgataggaaatgagaactatctggactacatgacttctatgaaaaggttcaagaatgaatcagatcctgagggtgcactctggtga

SEQ ID NO: 13223 - RNA, 9879 nt, synthetic construct
  misc_feature 1..9879: note = derived and/or modified CDS sequence (opt3) from DENV-1__KX380798__SS-prME
  source 1..9879: mol_type = other RNA
tccgtgaccatgctgctcatgcttatgcccacagcactggctttccacttgactacgagaggaggggagcctcatatgatcgtctccaagcaggaaagaggaaaatctttactgtttaagacctcagccggtgttaatatgtgcacattgattgccatggacctcggcgagctgtgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaactactcaagacagaggtgaccaaccctgccattctgaggaaactttgcatcgaagctaagatatctaatacgaccacagatagccggtgtccaactcaaggagaggccaccctggtggaagaacaagacgcaaacttcgtctgccgccgaacatttgttgatagaggctggggtaatgggtgtggattgttcggcaaaggctccctcattacttgcgctaagtttaagtgcgtgaccaaactggaggggaagatcgtacagtacgaaaacttaaaatattcagtgattgtcacagtgcacaccggagaccagcatcaagttggtaatgagagtactgaacacggcacgacagccaccatcactccccaggcgcctaccacagagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaattcagacctctggaacaactaccatatttgccggccatttaaaatgccgtctgaagatggataaactaacactcaaggggatgtcctatgtcatgtgtactggtagcttcaaactggagaaggaagtggctgagacccagcacggtacggtccttgtgcagatcaagtacgagggcacagacgcgccttgcaaaattccattctcgacccaagatgaaaagggggttactcagaacggacgcttgatcacagcaaatcccatagtgaccgacaaagagaagcctgtaaacattgaagccgagccaccctttggcgagtcttatatcgtcatcggtgctggggaaaaagccctgaagctctcctggttcaagaaaggctcaagtattggaaagatgtttgaggcaactgccagaggcgctaggcggatggccatcctgggggataccgcatgggacttcggaagcattggtggcgtgtttacatccgttgggaaacttgtgcatcagatattcggaacggcgtacggcgtcctgttttctggtgtgagctggaccatgaagatcgggattggcgtattgctcacttggctgggattaaattcacgaagtacatccctgagcatgacctgtatcgctgtgggcctagttacactctacctgggggtcatggtgcaggccgattctggatgcgtgatcaactggaaaggccgcgaacttaagtgtggttcagggattttcgtcactaatgaggttcacacctggacggaacaatataagtttcaggcagacagtccgaaaagattgagcgccgctataggaaaggcctgggaggagggcgtgtgcggtatcaggtccgcaacacggctggaaaacattatgtggaaacagatctctaacgagctcaatcatattctgttagaaaacgacatgaagttcaccgtggtagtcggcgatgtggctgggatcctggcccagggcaagaagatgatacgccctcaacccatggagtacaaatattcgtggaaaagctggggcaaggcgaagatcattggggccgacgttcagaatactacctttatcattgatggaccaaacacacctgaatgtcccgacgatcagagagcttggaatatctgggaggtggaggactacggcttcggtatatttactaccaacatttggcttaagttgagggattcctatacacaggtctgcgaccaccgtctcatgtcagcagccatcaaagatagtaaggctgtgcacgccgacatggggtactggattgaatctgagaaaaatgaaacgtggaagctggcacgggcgagcttcatcgaggttaagacctgtatatggccaaaatcccatactctatggtcaaacggagtgctggaaagcgagatgatcattcccaagatctatggcggtcctatttctcaacacaattaccgaccaggctacttcacacagaccgccgggccgtggcatctcggaaaactggagcttgattttgacttgtgcgaaggcactacagtagtcgtggatgagcactgcgggaacagaggaccctccctgaggaccacgactgtgaccggcaagatcatacacgaatggtgttgccgcagttgtacattacctccactccggttcagaggtgaggacgggtgctggtatggaatggagattaggcccgtcaaagaaaaggaggaaaatctggttaagagcatggtgtctgctggctccggtgaggtagactcatttagtcttggcctgttgtgtatcagcatcatgattgaagaggtgatgcgctcgcgatggtcccggaaaatgctcatgaccgggactctggccgtcttcctactgctcatcatgggacagctgacatggaacgatcttattcgtttgtgcataatggtgggcgcaaatgcttctgacagaatggggatgggaaccacatacctggccttaatggcaacttttaagatgaggcctatgttcgccgttggcctcctgtttcgccggcttaccagcagagaggtgctgctactcacgatcggtctgtcattggtcgctagtgtggaactgccaaactccttagaggaactcggggatggactggcgatgggcattatgatccttaaactgttgacagacttccaatctcatcagctctgggccaccctgctaagcctgacttttattaagaccacattctcccttcactatgcatggaaaactatggctatggttctctcaatcgtgagcctgtttcccttgtgtctgagtaccacgtctcagaagacaacctggttaccggtcctcctgggctcccttgggtgcaagcctctgactatgttcttgatagccgagaataaaatctggggaaggcgaagctggccactcaacgaaggtattatggccgtaggcatcgtgtcgattctgctatcatctctgcttaagaacgatgttcccctcgctgggcctctgatcgcaggaggcatgttgatagcctgttacgtgattagtggttccagcgcggacttatctctggagaaagctgccgaggtcagctgggaagaggaagcagagcattccggggcctcacacaatatcctcgtggaagtacaggatgacggaacaatgaagatcaaagatgaggagcgcgacgataccctgactattcttctgaaggctacattgctagcagtgagtggcgtctatcccctgagcataccagccaccctctttgtttggtacttctggcagaaaaagaagcagcggtctggcgtgctgtgggacacgccttcacccccagaagtggagagagcggtccttgatgacgggatctataggattatgcagcgtggattactgggtcgcagccaggtgggcgttggggtattccaagaaaacgtgtttcatactatgtggcacgtcacccggggagctgtgctcatgtaccagggcaaaagattggagccgagttgggccagcgttaagaaagacctgatctcctacggtgggggatggaggctccagggctcttggaatacaggcgaggaagtgcaggtcattgcagtggagcctgggaagaaccccaaaaatgtacaaaccgccccaggaacattcaagactcccgaaggtgaggtcggcgctatcgccctggattttaagcctgggacctcgggaagcccaatagtgaaccgagaaggcaaaatcgttggtctttatgggaatggagtggtcacgacatcaggcacttacgtgtccgcaattgctcaggccaaggcgagtcaggagggccccctgcctgagatcgaagacgaggttttccggaaacgcaacttgaccattatggatctacacccggggtctggaaagacaagaaggtatctgccagccatcgtgcgggaagcaataaaacgaaagctcagaaccttaattctggctcccactcgcgtcgtggccagcgagatggctgaagcacttaagggtatgcctatcaggtaccaaaccacagccgtaaaatccgagcatacgggcaaggagatcgtggacctgatgtgccacgccacttttaccatgcgtctcttgtcaccagttcgggtccccaattataacatgattatcatggatgaagctcatttcacagacccttctagcatagcggcaagagggtacattagtaccagggtgggaatgggcgaggccgctgccatctttatgactgcaacaccgcccggttccgtggaagccttcccacagagcaatgctgtcattcaggatgaggaacgcgacatccctgagcgatcttggaactcagggtatgagtggataaccgattttcccggaaaaacggtatggttcgtgccatccattaagagtggcaatgacatcgcgaactgtctgaggaaaaatggcaagcgggttatccagctcagcaggaagacttttgatacagaataccagaaaaccaagaacaacgactgggactacgtggtcaccactgatatttcggagatgggggccaatttccgcgcagaccgtgtgatcgatcctagacggtgcctgaaacccgttattcttaaggacggaccagaaagggtgatactagctggtccgatgcctgtcacagtggcctctgcagcccagcgccgaggcagaatcgggcggaaccacaataaagagggagatcagtatatttacatgggccagcccctgaacaatgacgaggatcatgctcactggaccgaagccaagatgttgttagacaacatcaatacaccagagggtatcattcccgcgctgttcgaacctgagagggaaaagtccgcagccatagatggggagtatcgcctcagaggcgaggctaggaaaacttttgtagaactgatgcggcgtggagaccttccagtgtggctgagctacaaggttgcctcagagggcttccaatatagtgatcgccgatggtgctttgacggggaaagaaacaatcaggtcctcgaggaaaacatggatgtggagatctggacgaaagagggagaaaggaagaaattgcggccccgctggctggacgctagaacctactctgaccctctagcactgagggagttcaaggaatttgccgctggtcggcgatccgtgagcggcgatctcattcttgagatcgggaaactgccgcagcacttaacacagagagcccaaaatgcattggacaacctggtcatgctccataattcagaacagggaggccgcgcgtataggcacgccatggaggagctgccagatactattgaaacccttatgctgctcgctttgatcgccgttctgacaggtggggtgaccttattctttctaagtggccggggactgggcaagactagcatagggctcctttgtgtaatggcatcctctgtgctgttgtggatggctagcgtcgagccccattggatcgccgcatccattatcctggagttctttctcatggtgctgcttattcctgagcccgaccgtcagagaacgccacaggataaccaactcgcctacgttgtgatcggactgttgttcatgatactgaccgtcgctgcgaatgagatgggtttactagaaacaactaagaaagacctgggcattgggcacgtagccgtgggaaaccaccatcacgcagctatgctcgatgttgaccttcatcctgcctcagcctggaccctgtacgcagtggctacaaccatcattactcccatgatgaggcacacaatcgagaacacgaccgccaatatatctttgactgcgatcgctaaccaggccgcaattctgatgggcctcgataagggttggccaatcagtaaaatggacattggggtccctctgcttgccttaggctgctattcgcaagtgaatccgctgacactcaccgctgcagtcttgatgctggtggcccattacgcgatcataggacccggcctacaagctaaggccacccgcgaagcacagaaacggacagccgctgggattatgaagaacccaactgttgatggaatcgtggccatcgacctggatcctgtagtgtatgacgcaaagtttgagaaacagctcggccagattatgcttctgatcttgtgtacgagccaaatactgctcatgcgaaccacatgggctctgtgcgaatccattactttagccaccggtccccttacaaccctgtgggaggggtctccaggaaagttctggaatactacgatcgcggtctcaatggccaacatttttagaggcagctacctcgcaggagctggcctagccttctccctgatgaaaagtctagggggaggcaggcgcgggacaggagcacagggcgagaccctgggtgaaaagtggaaacggcagctcaatcagctttctaagagcgagttcaacacttataagagatcagggatcatggaagttgaccgttccgaggctaaagaaggactgaagaggggcgagaccacaaaacacgccgtgagtcggggtactgccaagttgcgctggtttgtcgagcgaaatctggtgaaacctgaaggcaaggtaatagatctcgggtgtggaagaggcgggtggagctactattgcgcgggattaaagaaagtgaccgaggttaagggctacacaaaaggtgggcccggacacgaagaaccgatcccaatggctacgtacggctggaacctggtgaaacttcattctggcaaagacgtcttctttattcctcccgaaaagtgtgataccctgctatgcgacatcggggagtcctcaccaaatcccactattgaggaaggaaggacactccgggtgctgaaaatggtcgagccttggttgcgcggtaaccaattctgtatcaagattctgaatccgtatatgcccagcgtggttgaaaccctcgagcagatgcagagaaagcacggcgggatgcttgtaaggaacccactgtcgcgaaattctactcatgagatgtactgggtgagttgcggaacaggcaacatcgtctccgcagtgaatatgaccagccggatgttactgaaccgttttacgatggcccacagaaaacctacctatgaacgcgatgttgacttgggtgctgggacaaggcacgtggccgtcgagcccgaagtggcaaacctcgatataattggacagcggatcgagaatatcaagcatgaacacaaatcaacttggcattacgacgaggataacccttataagacctgggcctaccacggctcctatgaggtaaaaccatctggcagcgctagttccatggtgaatggggttgtcaagctgctaacaaagccctgggacgtgattcctatggtgactcaaatagcgatgaccgatacaaccccattcggacagcagagagtctttaaagaaaaggttgacactcgcacgcccaaagccaagaggggtacagcacaaatcatggaggtgaccgctaaatggctttggggcttcctgagccgaaacaagaagccgcggatttgtactagagaagagtttaccaggaaagtacgctctaatgccgcaatcggggccgtgttcgtcgacgaaaaccagtggaactcagctaaggaggccgtggaggatgaacgtttttgggacctcgttcataaagagcgggaactgcacaagcagggaaaatgcgcgacatgcgtgtacaacatgatgggcaagagagagaagaaattgggtgagttcgggaaggcaaaaggaagtagggccatttggtacatgtggctgggcgctcgctttctcgagttcgaggcccttggcttcatgaatgaagatcactggttttcccgagagaacagcctgtctggggtcgaaggagagggtttacataagctgggctatatcttgcgggacatatcgaaaatccctgggggaaatatgtacgcagatgacacggctggctgggataccagaattactgaggacgatctccagaacgaagccaggatcacagacattatggagccagaacacgctctgctagccaagtcaatcttcaaacttacctatcaaaataaggtggtacgcgttcagagacccgcaaagaacggtactgtgatggatgtcataagccggagggaccagcgtgggtccggacaggtgggcacatacggcctgaatacctttacaaacatggaggcgcaactcattcgacagatggaaagtgaggggatcttctctcctagcgagctggaaactccaaacttggccgagcgcgtgttagattggctggaaaaatatggagtcgagagactcaagcggatggctatctccggtgacgactgtgttgtgaaacccattgatgacaggtttgccaccgcacttacggctctgaatgatatgggcaaggtacgcaaagacataccgcagtgggaaccttcaaaggggtggaacgattggcagcaagtgcccttctgcagtcatcactttcaccagctaatcatgaaggacggaagagagattgtcgtgccatgtcggaatcaggatgagctggttggcagggcccgagtgtctcagggtgcagggtggagcctccgtgaaaccgcctgcttgggaaaatcctacgcgcaaatgtggcagctgatgtatttccatagacgcgaccttcggctggctgccaacgcaatctgttcagccgtccctgtggattggattcccacaagcaggactacctggtctatccacgctcatcaccagtggatgacaactgaggacatgctctccgtatggaatagagtttggatagaagagaacccatggatggaagataagacccatatcagtagctggggcgacgtgccctacttaggcaaacgcgaggaccaatggtgcgggtcgctgattggattgacggcccgggcaacatgggctaccaatatccaggtcgccattaaccaggtgaggcgactgatcggtaatgagaactacctcgattatatgacttccatgaagagatttaaaaatgaatctgaccctgagggcgcgctttggtga

SEQ ID NO: 13224 - RNA, 9879 nt, synthetic construct
  misc_feature 1..9879: note = derived and/or modified CDS sequence (opt3) from DENV-1__KJ649286__SS-prME
  source 1..9879: mol_type = other RNA
agcgtgaccatgctgctcatgcttctgcccacagtcttggccttccacttaactacgcgaggaggggagcctcatatgatcgttaccaagcaggaaaggggaaaatccctgctatttaagacatctactggtgtgaacatgtgcaccctcattgctatggacctgggcgagctttgtgaagatacaatgacctacaaatgcccacggataactgaggcagaaccggacgatatcgactgttggtgcaatgccacagatacctgggtaacgtatgggacttgttcacaaaccggagagcaccgccgagacaagcgtagcgtggcgctggctccccatgtcggcttgggtctcgagacaagaactgaaacctggatgagctccgagggggcctggaaacagattcagagggtggaaacatgggcactgcggcaccctggattcaccgttacggccctgtttctcgctcatgcaatcggcacttctattacacagaagggcatcatattcatcttactgatgcttgtgaccccatcgatggccatgcgctgcgtcgggattggaaacagagattttgtggagggtttgtcaggcgctacttgggtagacgttgtgctggagcacgggagctgtgtcacaaccatggccaaggataaacccacgctagacatcgaactcctgaagaccgaggtgacaaatcctgcggtgcttaggaaactgtgcattgaagcaaagatcagtaacactaccacagattcccggtgtccaactcaaggagaggccaccttggtcgaagaacaggacgctaatttcgtttgccgccgaacatttgtggatagaggctggggtaacgggtgtggactcttcggcaaaggctctctgataacctgcgccaagtttaagtgcgtaactaaattagaggggaagattgtgcagtacgaaaatctgaaatatagcgtcatcgtgacggttcacacaggagaccagcatcaagtgggtaacgagtccaccgaacacggcactaccgcaacaattacaccccaggctcctacttcagagatccagctcacagactacggggcccttacgctggattgtagtccaaggaccggattggacttcaatgaaatggtcctactgactatgaaggagaaaagctggctcgtgcataagcagtggtttctggatcttccgctgccctggacatctggcgcgaccacatcccaagagacttggaaccggcaggacttgctcgtaaccttcaaaacggcccacgcaaagaagcaggaagttgtggtcctgggttcacaagagggggctatgcacaccgccttaacaggcgctactgaaatccagaccagcggaacaactaccatttttgccggccatctgaaatgccgtctaaagatggataaactcacgctgaaggggatgagttatgtgatgtgtacaggatctttcaaacttgagaaggaagtcgtggagacccagcacggtactgttttggtgcaggtaaagtacgagggcacagacgcaccttgcaaaataccattcctgacccaagatgaaaagggggtcactcagaatggacgcgtgatcaccgccaaccccattgttacagacaaagagaagcctgtgaatatcgaagctgagccaccctttggcgagtcctatatagtcgtgggtgcgggggaaaaagcactcaagctgagctggttcaagaaaggctcgacgattggaaagatgtttgaggccaccgctagaggcgccaggcggatggcaatccttggggatactgcctgggacttcggatctatcggtggcgtatttacatccgtggggaaactggttcatcagattttcggaaccgcttacggcgtcttgttttcaggtgtgagttggacaatgaagatcgggattggcgtgctcctgacttggttaggactgaacagccgatccacctctctaagcatgacgtgtatagccgtcggcctcgttacactgtaccttggggtgatggtgcaggcagattcaggatgcgtaatcaattggaaaggccgcgaattgaagtgtggtagtgggattttcgtcaccaacgaggtgcacacttggaccgaacaatataagtttcaggcggactccccgaaaagactgagcgctgccatcggaaaggcatgggaggagggcgtttgcggtatcaggtctgccacacggctcgaaaacattatgtggaaacagatatcaaatgagctgaaccatatcttactggaaaatgacatgaagttcactgtggtcgtgggcgatgttagtgggattcttgctcagggcaagaagatgatccgccctcaacccatggagcacaaatacagctggaagtcctggggcaaggccaaaattatcggggcagacgtgcagaactctacctttataatcgatggaccaaatacacctgaatgtcccgacgatcagagagcttggaacatttgggaggtagaggactatggcttcggtatctttacgaccaatatttggttgaagctcagggattcgtacactcaggtctgcgaccaccgtctgatgagcgccgcgatcaaagattccaaggccgtgcatgctgacatggggtattggatagaatcagagaaaaacgaaacatggaagctagcacgggccagtttcattgaggtgaagacctgtgtctggccaaaatctcacactctgtggagcaatggagttctcgaatccgagatgatcattcccaagatctacggcggtcctatatcacaacataactatcgaccaggctacttcacacagaccgctgggccgtggcacctgggaaaacttgagttggattttgacctgtgcgaaggcacgactgtggtagtggatgagcactgcgggaatagaggacccagcttaaggaccacaaccgtcactggcaagatcattcatgaatggtgttgccgctcttgtacactccctccactgcggttcaaaggtgaggacgggtgctggtacggaatggagatcagacccgtgaaggaaaaggaggaaaaccttgttaaatccatggtgagtgccggcagcggtgaggtcgactctttttccctgggcttgctctgtatttcaatcatgatagaagaggtgatgaggagtcgctggagccgaaagatgctgatgaccgggacactagcagttttcctgctcctgattatgggacagcttacttggaatgatttgatccggctgtgcatcatggtgggcgcgaacgcctcggaccgtatggggatgggaaccacgtatttagctctcatggccacatttaaaatgagacctatgttcgcagtcggcctgctttttaggcgcctgacctcccgggaggtactactcctgactattggtttgtctctggtggctagcgttgaattaccaaattcactcgaggaactgggggatggacttgccatgggcatcatgattctgaagttgctcaccgacttccaaagtcaccagctgtgggcagccctactgtcccttacatttataaaaactacctgttctctccattacgcttggaagacgatggcgatggtgctgagcatcgtctccttgttccccctgtgcatgtcaacaaccagccagaagactacatggttaccggtgctcctgggcagtcttgggtgtaaacctctgaccatgtttttgattgccgagaacaagatctggggaagaaaatcttggccactcaacgaaggtattatggcagtaggcatcgtgtccatactgctaagctcgctgcttaagaatgatgtccccctcgctgggcctctggttgccggaggcatgttgatcgcctgctatgtgatttcaggttctagtgctgacttatccctggagaaagcagccgaggtgagctgggaagaggaagcggagcactctggggctagccataacatcctcgtcgaagtgcaggatgacggaactatgaagattaaagatgaggagagggacgatacactgaccatccttctgaaggccacgttgctagcagtttccggcgtataccccctgtcaataccagccactctcttcgtgtggtatttttggcaaaagaaaaagcagcgaagtggcgtcctgtgggacacccctagtcccccagaagtggagcgcgctgttcttgatgacgggatttaccggatcatgcagagaggattactgggtaggtctcaggtgggcgtcggggtgttccaagaaaatgtattccacacaatgtggcacgtcacccgtggagcagtgctcatgtataaaggcaagcgcttggagccgacatgggcctccgttaaaaaggacctgatctcatacggtgggggatggcggctccagggcagttggaacactggcgaggaagtgcaggtcattgcggtggagcctgggaagaatcccaaaaacgttcagaccgctccaggaacgtttaagacacccgaaggtgaggtgggcgccatagcactggatttcaaacctgggactagcggatccccaatcgtcaatagagaaggcaagattgtgggtctttacgggaacggagtagtgaccacatctggcacctatgtttcggccatcgctcaagccaaagcaagccaggagggccccctgcctgagattgaagacgaggtctttaggaagcgaaatttgactatcatggatctacatccggggtcaggaaagacccggcgctacctgccagctatagtgagagaagccatcaaaaggaagctccggacattaattctggcgcccacgcgagtggtcgcctccgagatggcagaagctcttaaaggtatgcctatcagatatcagactaccgccgtaaagagtgagcacacaggcaaagagattgtggacctgatgtgtcatgctaccttcactatgcgcctcttgtctccagttagggtgcccaactacaatatgatcataatggatgaagcacactttacagaccctagctccattgccgcccgtgggtatatctcaacccgggtcggaatgggcgaggctgcggcaatcttcatgacggccactccgcccggttctgtggaggcttttccacaaagcaacgccgttattcaggatgaggaaagagacatccctgagaggagttggaactccgggtacgattggataacagacttccccggaaagaccgtgtggtttgtcccaagcattaagtctggcaacgatatcgcaaattgcctgcgcaaaaacggcaagcgagtgattcagctctcaagaaaaaccttcgacactgagtatcagaagaccaaaaataatgactgggattacgtagtgaccacagacatctccgaaatgggggccaactttcgggctgatagggttatagaccctcgccgttgcctgaagcccgtcattcttaaggatggaccagagagagtgatcctagcgggtccgatgcctgtgactgtcgccagtgcagctcaacggaggggccgcatcgggcgaaatcagaacaaagaaggagaccagtacatttatatgggccagcccctgaataacgatgaggaccatgcccactggacggaggcaaagatgttgttagataatatcaacaccccagaaggtattatacccgccctgttcgagcctgaaagagagaaaagcgctgccatcgacggggaataccggctcaggggcgaggcgcgcaagacattcgttgagctgatgagaaggggagatcttccagtgtggctgtcgtataaagtagcatctgaaggctttcaatactccgaccggcgttggtgtttcgatggggagcgcaataaccaggtgctcgaagagaatatggacgtcgaaatttggactaaggagggagagaggaaaaagttgagacccagatggctggacgcccggacctatagcgatcctctagctctgcgcgaatttaaggagttcgccgctggtagaaggtcagtgagtggcgacctcatccttgaaatcgggaaactgccgcagcacttaacacagcgggcacaatctgccttggataacctggttatgctccataattccgagcagggaggccgagcttacagacacgccatggaggaactgccagacaccattgagactcttatgctgctcgcattgatagcggtgctgacgggtggggtcaccttatttttcctaagcggcaagggactgggcaaaacatcaatcgggctcctttgcgtaatggccagtagcatgctgttgtggatggcttccgtggaaccccattggattgccgcatctatcattctggagtttttcctcatggttctgcttatccctgaacccgatcgccagaggactccacaggacaaccaactcgcttatgtggtcataggactgttgtttatgatcctgaccgtggccgcaaatgagatgggtttactagagacaaccaagaaagatctgggcattgggcacgtcgccgtggaaaaccaccatcacgctactatgctcgacgttgatcttcatcctgcgagcgcctggacactgtacgcagtggctacgaccatcattactcccatgatgcggcacacaatcgagaacaccaccgccaatatatccttgacagccattgcaaaccaggctgccatcctgatgggactcgacaagggctggccaatttcaaagatggatatcggtgtacctctgcttgcgttagggtgttactctcaggtgaatccgatgactctgacggctgccgtcctcatgttggttgcacattataccataatcggccccggactgcaagccaaagctacacgtgaagcacagaagagaactgccgcgggcattatgaaaaacccaaccgtggacgggatcgtcgctattgatctagaccctgtggtatacgacgccaagttcgagaaacagctgggacagatcatgctccttatactgtgcacaagtcaaattttgctgatgaggaccacttgggcactctgtgaatcgatcacgctggccacaggccccttaaccactctttgggagggtagcccagggaagttttggaataccacaatcgctgtgtccatggccaacattttccgcggatcttatctggcaggcgctggtctcgccttttcactaatgaaaagcctgggcgggggacggcgaggcactggggcgcagggagagaccttgggcgaaaaatggaagagacagctgaatcagctctccaaaagtgagttcaacacatacaagaggtctggtatcatagaagttgatcgcagcgaggccaaagaagggcttaagcggggagagacgaccaagcacgcagtgtcaagaggcactgctaaactgcgttggttcgtcgagaggaatttggtgaagcctgaaggtaaagtcattgacctgggctgcgggcggggaggctggtcctattactgtgccgggctcaagaaagtgacagaggttaagggatataccaaaggcggtgcagggcacgaggaacccatcccgatggctacttacggatggaacttagtaaagctgcatagtggcaaggatgtgtttttcattccacctgaaaaatgcgacacacttctgtgtgatatcggcgagagctctcccaatccaaccatagaggaagggcgcacgctacgagtcctcaagatggtggagccctggctgagaggaaaccaattttgcatcaaaattttgaatccttacatgccgtccgttgtggaaaccctggagcagatgcagaggaagcacggtggcatgctcgtccggaaccccctttcacgcaatagcacacatgagatgtattgggtgtcgtgtgggactggaaacatcgtatctgccgtgaatatgaccagtagaatgctgttaaacaggttcacaatggcccaccgaaaaccaacttacgaacgggacgttgatctgggcgcgggtacccgtcacgtcgctgtggagcctgaagtggcaaacttggacattatcgggcagagaattgagaatatcaagcatgaacacaagtccacatggcattatgatgaggacaacccctacaaaacctgggcctatcacggaagctacgaggtcaagccttcaggctccgcttctagcatggttaatggcgtggtacgcctcctgactaaaccatgggatgtgatacccatggtcacgcaaattgccatgacagacaccactccttttgggcagcagagggtgttcaaggaaaaagttgacacccggacaccaaaggcaaagagaggaacggcccaagtgatggaggtcaccgctcgctggctatggggttttcttagtaggaacaaaaagccccgaatctgcactcgggaagagttcacaagaaaagtgaggtccaatgcggccatcggcgcagtatttgttgatgaaaaccagtggaatagcgctaaggaggccgtggaggacgaacgcttctgggatctggtccatcgtgagcgggaactccacaaacaggggaagtgcgcaacctgtgtgtataacatgatgggaaagagagagaaaaagctgggcgaatttggtaaagccaaggggtctagggctatttggtacatgtggttgggagcccgcttcctggagtttgaggcgctcggcttcatgaatgaagaccactggttctcacgagagaacagtctttccggcgtggaaggggagggactgcatcggttaggttacatactgagagatatcagcaaaattccgggcgggaatatgtatgcagacgatactgccggatgggacacaaggatcaccgaggatgacttgcagaacgaagctaagattacagatatcatggagcctgaacacgccctcctggcaacttctatatttaaactaacctaccaaaataaggtcgttcgcgtgcagagaccagctaagaacggcacggtaatggacgtgatctcgcggagggatcagcgtggttcagggcaggtcggaacctatggccttaatacattcactaacatggaggcccaactgattcgacagatggaaagcgagggcctcttttcccccagtgagctggaaacccctaacttggctgagcgcgtgttaaattggctggggaaatacggagttgaaagactcaagcggatggccatctctggtgacgactgcgtggtcaaaccaattgatgacaggttcgcaacagcgcttactgccctgaacgatatgggcaaggtgcgcaaagacatcccccagtgggagccgagcaaggggtggaatgattggcagcaagtacctttttgttcccatcacttccaccagctaataatgaaggacggaagagaaattgttgtgccctgccggaaccaggatgagctggtcggcagggctcgagtgtcacagggtgccgggtggagtctccgtgagaccgcatgtttgggaaaatcttatgctcaaatgtggcagctgatgtactttcatagacgcgaccttcggctggccgcaaatgccatctgcagcgcggttccagtggattgggtccctacgtccaggacaacctggtcaatccacgctcatcaccagtggatgactacagaaaacatgctcagcgtgtggaatagagtatggattgaggaaaacccctggatggaggacaagacccatgtgtcttcctgggaagatgtcccatatttaggcaaacgcgaggaccaatggtgtggcagtctgatagggttgactgcccgggcaacctgggccacaaatatccaggttgctattaaccaggtgaggaagctgatcggaaatgagaactacctcgactacatgacgagcatgaaacgattcaagaatgattcggaccccgaaggtgccctttggtga

SEQ ID NO: 13225 - RNA, 9879 nt, synthetic construct
  misc_feature 1..9879: note = derived and/or modified CDS sequence (opt3) from DENV-1__KF887994__SS-prME
  source 1..9879: mol_type = other RNA
tccgtgaccatgctgctcatgcttatgcccacagccctggctttccacttgactacgagaggaggggagcctcatatgatcgtctccaagcaagaaagaggaaaatctttactgtttaagacctcagcgggtgttaatatgtgcacactgattgccatggacctcggcgagctgtgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaactgctcaagacagaggtgaccaaccctgccattctgaggaaactttgcatcgaagctaagatatctaatacgaccacagatagccggtgtccaactcaaggagaggccaccctggtggaagaacaagacgcaaacttcgtctgccgccgaacatttgttgatagaggctggggtaatgggtgtggattgttcggcaaaggctccctcattacttgcgctaagtttaagtgcgtgaccaaactggaggggaagatcgtacagtacgaaaacttaaaatattcagtgattgtcacagtgcacaccggagaccagcatcaagttggtaatgagagtactgaacacggcacgacagccaccatcactccccaggcgcctaccacagagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaattcagacctctggaacaactaccatatttgccggccatttaaaatgccgtctgaagatggataaactaacactcaaggggatgtcctatgtcatgtgtactggtagcttcaaactggagaaggaagtggctgagacccagcacggtacggtccttgtgcagatcaagtacgagggcacagacgcgccttgcaaaattccattctcgacccaagatgaaaagggggttactcagaacggacgcttgatcacagcaaatcccatagtgaccgacaaagagaagcctgtaaacattgaagccgagccaccctttggcgagtcttatatcgtcatcggtgctggggaaaaagccctgaagctctcctggttcaagaaaggctcaagtattggaaagatgctggaggcaactgccagaggcgctaggcggatggccatccttggggataccgcatgggactttggaagcattggtggcgtgttcacatccgttgggaaactggtgcatcagatatttggaacggcgtacggcgtcttgttctctggtgtgagctggaccatgaagatcgggattggcgtactcctgacttggttaggactaaattcacgaagtacatccctaagcatgacctgtatcgctgtgggcctcgttacactgtaccttggggtcatggtgcaggccgattctggatgcgtgatcaactggaaaggccgcgaattgaagtgtggttcagggatttttgtcactaatgaggttcacacctggacggaacaatataagttccaggcagacagtccgaaaagactgagcgccgctataggaaaggcctgggaggagggcgtgtgcggtatcaggtccgcaacacggctcgaaaacattatgtggaaacagatctctaacgagctgaatcatattttactggaaaacgacatgaagtttaccgtggtagtcggcgatgtggctgggatccttgcccagggcaaaaagatgatacgccctcaacccatggagtacaaatattcgtggaaaagctggggcaaggcgaagatcattggggccgacgttcagaatactaccttcatcattgatggaccaaacacacctgaatgtcccgacgatcagagagcttggaatatctgggaggtggaggactacggctttggtatattcactaccaacatttggttgaagctcagggattcctatacacaggtctgcgaccaccgtctgatgtcagcagccatcaaagatagtaaggctgtgcacgccgacatggggtactggattgaatctgagaaaaatgaaacgtggaagctagcacgggcgagctttatcgaggttaagacctgtatatggccaaaatcccatactctgtggtcaaacggagtgctcgaaagcgagatgatcattcccaagatctatggcggtcctatttctcaacacaattaccgaccaggctacttcacacagaccgccgggccgtggcatctgggaaaacttgagttggatttcgacctgtgcgaaggcactacagtagtcgtggatgagcactgcgggaacagaggaccctccttaaggaccacgactgtgaccggcaagatcatacacgaatggtgttgccgcagttgtacactccctccactgcggtttagaggtgaggacgggtgctggtatggaatggagattaggcccgtcaaagaaaaggaggaaaatcttgttaagagcatggtgtctgctggctccggtgaggtagactcattcagtctgggcttgctctgtatcagcatcatgattgaagaggtgatgcgctcgcgatggtcccggaaaatgctgatgaccgggactctagccgtctttctgctcctgatcattggacagcttacatggaacgatttgatacgtctgtgcatcatggtgggcgcaaatgcttctgacagaatggggatgggaaccacatacttagccctcatggcaactttcaagatgaggcctatgtttgccgttggcctgcttttccgccggctgaccagcagagaggtgctactcctgacgattggtttgtcactgatggctagtgtcgaattaccaaactccctcgaggaactgggggatggacttgcgatgggcatcatgattctgaaattgctcacagactttcaatctcatcagctgtgggccaccctactgagccttactttcatcaagaccacattttccctccactatgcatggaaaactatggctatggtgctgtcaatagttagcttgttccccctgtgtttaagtaccacgtctcagaagacaacctggctcccggtgctgcttggctccctggggtgcaagcctttgactatgtttctcatcgccgagaataaaatttggggaaggcgaagctggccactgaacgaaggtatcatggccgtcggcattgtatcgatcctactgtcatctcttctcaagaacgatgtgcccctggctgggcctttgatagcaggaggcatgttaattgcctgttacgttatcagtggttccagcgcggacctgtctctcgagaaagctgccgaggtgagctgggaagaggaagcagagcattccggggcctcacacaatatcctggtcgaagtgcaggatgacggaacaatgaagattaaagatgaggagcgcgacgatacccttactatactgttgaaggctacactactggcagtaagtggcgtgtatcccctcagcatcccagccaccctgttcgtctggtacttttggcagaaaaagaagcagcggtctggcgttctttgggacacgccttcacccccagaagtggagagagcggtgttagatgacgggatttataggatcatgcagcgtggactgctcggtcgcagccaggtcggcgtgggggttttccaagaaaacgtattccatactatgtggcacgtgacccggggagctgtcttgatgtaccagggcaaaagactggagccgagttgggccagcgtgaagaaagacctcatttcctacggtgggggatggaggctgcagggctcttggaatacaggcgaggaagttcaggtgatcgcagtcgagcctgggaagaaccccaaaaatgtgcaaaccgccccaggaacatttaagactcccgaaggtgaggtaggcgctatagcccttgatttcaagcctgggacctcgggaagcccaatcgtcaaccgagaaggcaaaattgtgggtctgtatgggaatggagttgtgacgacatcaggcacttacgtctccgcaatcgctcaggccaaggcgagtcaggagggccccttgcctgagattgaagacgaggtgtttcggaaacgcaacctaaccatcatggatctgcacccggggtctggaaagacaagaaggtatctcccagccatagttcgggaagcaattaaacgaaagttaagaaccctgatccttgctcccactcgcgtggtcgccagcgagatggctgaagcactgaagggtatgcctatcaggtaccaaaccacagccgtgaaatccgagcatacgggcaaggagattgtagacctcatgtgccacgccactttcaccatgcgtttgctgtcaccagtgcgggttcccaattataacatgatcataatggatgaagctcattttacagacccttctagcattgcggcaagagggtacatcagtaccagggtcggaatgggcgaggccgctgccattttcatgactgcaacaccgcccggttccgtggaagcctttccacagagcaatgctgtgatccaggatgaggaacgcgacatacctgagcgatcttggaactcagggtatgagtggattaccgatttccccggaaaaacggtctggtttgtaccatccatcaagagtggcaatgacatcgcgaactgtctcaggaaaaatggcaagcgggtgattcagctgagcaggaagactttcgatacagaataccagaaaaccaagaacaacgactgggactacgttgtgaccactgatatctcggagatgggggccaattttcgcgcagaccgtgtcattgatcctagacggtgccttaaacccgtgatactaaaggacggaccagaaagggttatcctggctggtccgatgcctgtgacagtcgcctctgcagcccagcgccgaggcagaattgggcggaaccacaataaagagggagatcagtatatctacatgggccagcccttgaacaatgacgaggatcatgctcactggaccgaagccaagatgttactggacaacatcaatacaccagagggtattatacccgcactcttcgaacctgagagggaaaagtccgcagccatcgatggggagtatcgcctgagaggcgaggctaggaaaactttcgtggaacttatgcggcgtggagacctgccagtatggctcagctacaaggtggcctcagagggctttcaatatagtgatcgccgatggtgcttcgacggggaaagaaacaatcaggttttggaggaaaacatggatgtcgagatttggacgaaagagggagaaaggaagaaactgcggccccgctggctagacgctagaacctactctgaccctctggcactcagggagtttaaggagttcgccgctggtcggcgatccgtgagcggcgatcttatcctggagattgggaaattaccgcagcacttgacacagagagcccaaaatgcactggacaacctcgtgatgctgcataattcagaacagggaggccgcgcgtataggcacgccatggaggagcttccagatactatcgaaaccctgatgctcttggctctgatagccgtcttaacaggtggggttaccctatttttcctgagtggccggggactcggcaagactagcatcgggcttctgtgtgtgatggcatcctctgtattgctgtggatggctagcgtggagccccattggattgccgcatccatcattctcgaatttttcctgatggtccttctcatccctgagcccgaccgtcagagaacgccacaggataaccaactggcctacgtggttataggattgctgtttatgattttaaccgtggctgcgaatgagatgggtctactggaaacaactaagaaagacctcggcatcgggcacgtcgccgtaggaaaccaccatcacgcagctatgcttgatgtggacctgcatcctgcctcagcctggaccttgtacgcagttgctacaaccattatcactcccatgatgaggcacacaatagagaacacgaccgccaatatctctctgactgcgattgctaaccaggccgcaatcctcatgggcctggataagggttggccaattagtaaaatggacatcggggtgcctcttttagccctgggctgctattcgcaggtcaatccgctcacattgaccgctgcagtgctgatgctagtcgcccattacgcgataattggacccggcctgcaagctaaggccacccgcgaagcacagaaacggacagccgctgggatcatgaagaacccaactgtggatggaatcgttgccattgacctcgatcctgtggtatatgacgcaaagttcgagaaacagcttggccagatcatgctgttgatactgtgtacgagccaaattctcctgatgcgaaccacatgggctttatgcgaatccatcactcttgccaccggtcccctgacaaccctctgggaggggtctccaggaaagttttggaatactacgattgcggtgtcaatggccaacatcttcagaggcagctacctagcaggagctggcctggccttttccttgatgaaaagtctagggggaggcaggcgcgggacaggagcacagggcgagaccctcggtgaaaagtggaaacggcagcttaatcagctgtctaagagcgagttcaacacttataagagatcagggataatggaagtcgaccgttccgaggctaaagaaggattgaagaggggcgagaccacaaaacacgccgttagtcggggtactgccaagctgcgctggttcgtggagcgaaatctcgtcaaacctgaaggcaaggtgatcgatttagggtgtggaagaggcgggtggagctactattgcgcgggactgaagaaagtaaccgaggtgaagggctacacaaaaggtgggcccggacacgaggaaccgattccaatggctacgtacggctggaaccttgttaagctgcattctggcaaagacgtgtttttcatccctcccgaaaagtgtgataccctactctgcgacattggggagtcctcaccaaatcccactatcgaggaaggaaggacactgcgggtcttgaaaatggtggagccttggctgcgcggtaaccaattttgtattaagatcctcaatccgtatatgcccagcgtcgtggaaacccttgagcagatgcagagaaagcacggcgggatgctggttaggaacccattatcgcgaaattctactcatgagatgtactgggtaagttgcggaacaggcaacatagtgtccgcagtcaatatgaccagccggatgctgttgaaccgtttcacgatggcccacagaaaacctacctatgaacgcgatgtggacctcggtgctgggacaaggcacgttgccgtggagcccgaagtcgcaaacctggatattatcggacagcggatcgagaatattaagcatgaacacaaatcaacttggtactatgacgaggataacccttacaagacctgggcctatcatggctcctacgaggtgaaaccatctggcagcgctagttccatggtaaatggggtggttaagctacttacaaagccctgggacgtcatacctatggtgactcaaatcgcgatgaccgatacaaccccatttggacagcagagagtgttcaaagaaaaggtcgacactcgcacgcccaaagccaagaggggtacagcacaaattatggaggttaccgctaaatggctgtggggctttctcagccgaaacaagaagccgcggatctgtactagagaagagttcaccaggaaagtgcgctctaatgccgcaattggggccgtatttgtggacgaaaaccagtggaactcagctaaggaggccgtcgaggatgaacgtttctgggacctggtgcacaaagagcgggaattgcataagcagggaaaatgcgcgacatgcgtttacaacatgatgggcaagagagagaagaaactgggtgaatttgggaaggcaaaaggaagtagggccatctggtatatgtggctcggcgctcgcttccttgagtttgaggccctgggcttcatgaatgaagatcactggttctcccgagagaacagcttttctggggtggaaggagagggtttacacaagctgggctacatattgcgggacatctcgaaaattcctgggggaaatatgtatgcagatgacacggctggctgggataccagaatcactgaggacgatctccagaacgaagccaggattacagacatcatggagccagaacatgctctgctagccaagtcaatattcaaacttacctaccaaaataaggtcgtgcgcgtacagagacccgcaaagaacggtactgttatggatgtggtcagccggagggaccagcgtgggtccggacaggtgggcacatatggcctgaatacctttacaaacatggaggcgcaactcattcgacagatggaaagtgaggggatcttctctcctagcgagctggaaactccaaacttggccgagcgcgtgttagcttggctggaaaaatacggagtcgagagactcaagcggatggccatctccggtgatgactgtgttgtgaaacccattgacgataggtttgcaaccgctcttacggccctgaatgacatgggcaaggtacgcaaagatataccgcagtgggaaccttcaaaggggtggaacgactggcagcaagtgcccttctgcagtcaccattttcaccagctaatcatgaaggatggaagagagattgtcgtgccatgtcggaatcaggacgagctggttggcagggcacgagtgtctcagggtgccgggtggagcctccgtgaaaccgcgtgcttgggaaaatcctatgctcaaatgtggcagctgatgtacttccacagacgcgatcttcggctggccgcaaacgccatctgttcagctgtccctgtgaattggattcccacaagcaggactacctggtctatccatgcccaccatcagtggatgacaactgaggacatgctctccgtatggaacagagtttggatagaagagaatccatggatggaagataagacccacatcagtagctggggcgacgtgccctacttaggcaaacgcgaggatcaatggtgcgggtcgctgattggattgacggcacgggctacatgggccaccaacatccaggtcgcgattaatcaggtgaggaagctgatcggtaacgagaattatctcgactacatgacttccatgaaacgatttaagaacgaatctgaccctgagggcgctctttggtga

SEQ ID NO: 13226 - RNA, 9879 nt, synthetic construct
  misc_feature 1..9879: note = derived and/or modified CDS sequence (opt3) from DENV-1__JQ675358__SS-prME
  source 1..9879: mol_type = other RNA
agcgtgacaatgctgctcatgcttctgcccacagcattggctttccacttaactacgcgaggcggggaacctcatatgatcgtctccaagcaggaaaggggaaaatctctgctatttaagacctcagccggtgttaacatgtgcacactcattgccatggacctgggcgaactttgtgaagatactatgacctacaaatgcccacaaataacagaggcggaaccggacgatgtggactgttggtgcaatgctaccgatacttgggtaacatatgggacctgtagtcagacgggagagcaccggcgcgacaagcgaagcgtggccctggcaccccatgtcggcttgggtctcgagactcgtaccgaaacatggatgtcctctgagggggcctggaaacagatccagagagtggaaacttgggctctgaggcaccctggattcaccgttattgcactgtttctcgcccatgctatcggcacatcgattacccaaaagggcatcatattcatcttactgatgcttgtgacgccatcaatggccatgcggtgcgtcgggattggaaaccgcgattttgtggagggtttgagcggcgcgacttgggtagacgttgtgctggagcacgggagttgtgtcacaaccatggcaaagaataaacccactctagatatcgaactcctgaagacagaggtgaccaaccctgccattcttagaaaactgtgcatcgaagctaagatatccaatacgaccacagactctaggtgtccaactcagggagaggccaccttggtggaagaacaggatgcaaacttcgtctgccggcgcacatttgttgaccgaggctggggtaatgggtgtggactcttcggcaaaggcagcctgttaacttgcgctaagtttaagtgcgtgaccaaactggaggggaagattgtacagtacgaaaacctcaaatattccgtgatcgtcacagtgcacaccggagatcaacatcaggttggtaatgagactacggaacacggcacaattgccaccatcactccccaggcgcctacctcagagatccagcttacagactacggggccctgaccttggactgtagtccaagaactggactagatttcaacgaaatggtgctgctcacaatgaaggagaggagctggctggtccataaacaatggtttcttgacctgccgttgccctggacgtctggcgcatccacctcacaggagacttggaatcggcaggatctcctggtgacattcaagaccgctcacgccaaaaagcaagaagtagttgtgttaggtagccaggagggggctatgcacacagccctgactggcgcaaccgaaattcagacgagtggaaccacaactatatttgccggccatctaaagtgccgtctcaaaatggacaagctgacccttaaagggacatcttatgtcatgtgtactggatccttcaagttggagaaagaagtggctgagacccagcacggtacggtcctggtgcaagttaagtacgagggcacagatgcgccttgcaagatcccattcagcacccaggacgaaaaaggggtgactcagaacggacgcctcattacagcaaatcccatcgtaaccgataaggagaaacctgtcaacatagaaactgagccaccctttggcgagtcgtatattgtggttggtgccggggaaaaggctctgaaactttcttggttcaagaagggctcctcaatcggaaaaatgtttgaggccaccgcaagaggcgccaggcggatggctatcctgggggacacagcctgggatttcggaagtattggtggcgtgtttacgagcgtcgggaagttggtgcatcaggtattcggaaccgcatacggcgtgctcttttccggtgtttcttggactatgaaaatcgggattggcatactgttaacatggctgggactaaatagccgatcaaccagtctctccatgacatgtatcgcggtcggcatggtgactctgtaccttggggtgatggtccaagctgacagcggatgcgttattaactggaagggccgcgaattgaaatgtggttctgggatcttcgtgaccaacgaggtgcacacgtggacagaacagtataagtttcaggccgattcaccgaagagactgagtgcagccatcggaaaggcttgggaggagggcgtatgcggtattaggagcgccacccggctcgaaaatataatgtggaagcagatctccaacgagctgaatcatattttactggaaaacgacatgaaattcactgtcgtggttggcgacgcaaatgggatccttgctcaaggaaagaaaatgattcgccctcagcccatggagcacaagtactcttggaaatcgtggggcaaggccaagatcataggggcggatatccagaacaccacatttattatcgacggaccagatactcctgaatgtcccgacaatcagagagcctggaacatttgggaggtggaggattatggcttcggtatctttaccacaaatatatggttgaaactcagggacagctacacgcaaatgtgcgatcaccgtctgatgtccgctgcaattaaggactcaaaagccgtccatgctgatatggggtattggatcgaaagtgagaagaacgaaacctggaaactagcccgggcatctttcattgaggtgaagacttgtacatggccaaagagccacaccctgtggtccaatggagttctcgaatcagagatgatcatacccaaaacttacggcggtcctatcagccagcataactatcgaccaggctacttcacacagaccgcggggccgtggcacctgggaaaacttgagttggactttgatctgtgcgaaggcacgactgtggtagtcgacgagcactgcgggaatagaggaccctctttaaggaccacaaccgtgactggcaaaattatccatgaatggtgttgccgctcctgtacactccctccactgcggttcagaggtgaggatgggtgctggtacggaatggagattaggcccgtgaaggaaaaagaggaaaaccttgtccgcagtatggttagcgccggctctggtgaggtggactccttttcactgggcatcttgtgtgctagtataatgattgaagaggtaatgcgaagccggtggtcgcgtaagatgctcatgaccgggacactggccgtgttcctactgctcatcatgggacaactgacttggaatgaccttatcagattgtgcattatggtcggcgcaaacgcttccgataggatggggatgggaaccacgtatctggccttaatggcaacatttaagatgcgccctatgttcgccgtgggcctcctgtttcggagacttacctctagggaggttctgctactcactatcggtctgagcttggtggcttcagtcgaactgccaaacagtttagaggaactcggggacggactggcgatgggcattatgatgcttaaactgttgaccgagttccagccccaccagctctggacaactctgctatccctgacctttataaagacgacactttctctcgattacgcctggaaaaccactgcaatggctctgagcatcgtgtccttgttcccgctgtgtttatcaacaaccagccagaagactacatggctccctgttctgcttggcagttttgggtgcaaaccactgaccatgttcttgattacggaaaataagatctggggacgaaagtcttggcccctcaacgagggtattatggccatcggcatagtgtccctgctactgagctcgcttctcaaaaatgacgtccctctggccgggcccttgatcgctggaggcatgttaattgcatgttatgtaatctcaggttctagtgccgatctgtccctcgagaaggcggctgaagtgagctgggagcaagaagccgagcattctgggactagccacaacattctggttgaagtgcaggacgatggaaccatgaaaatcaaggacgaggagcgcgatgacacacttaccatactggtcaaagcaacattgctagccgtgtccggcgtatacccaatgtcaattcctgctactctgtttgtgtggtatttctggcagaagaaaaagcagcggagtggcgtcctctgggatacccccagcccaccggaagttgagagagcagtgctggacgatgggatctacaggatccttcaacgtggattactgggtcgctctcaggtgggcgtcggggtgttccaggacggagtttttcatacgatgtggcacgtaacacggggcgccgtgctcatgtatcagggtaagagattggaaccttcctgggcgtcagtcaaaaaggacctgattagttacgggggaggctggaggttccaaggcagctggaatactggggaggaggtgcaggttatagctgtggaacccagaaagaacccaaagaatgtccagaccacacccggaacctttaaaactcctgagggtgaagtgggcgccatcgcactcgatttcaagccagggacctccggatctcccattgtaaaccgggagggcaagatcgtcggtctgtacgggaatggagtggttacaacgtcgggcacttatgtgagcgccattgctcaagccaaagcatcacaggaaggccctcttccggagatcgaggacgaagtctttaagaaacgcaacctgaccataatggatttgcacccagggtccggaaagacaagaaggtacctacccgctatcgtgcgggaggccattaaacgaaagctgagaaccctcatcttagcgcctactcgcgttgtggccagtgaaatggcagaggctctgaagggtatgccaattaggtatcagacaaccgccgtcaaatctgaacatacgggccgtgagatcgtggaccttatgtgccacgctactttcacaatgcggctgctcagccccgtaagagtgcctaattacaacatgataattatggatgaggcacattttaccgacccggcctccatcgccgctagggggtatatctcaacccgcgttggaatgggcgaagcggcagccattttcatgactgctacacccccaggttctgtcgaggcctttcctcagagcaatgcagtgatccaagatgaagaacgagacatacccgaaagaagttggaactccgggtacgattggattaccgacttcccaggaaagacagtgtggtttgtccctagcatcaaatctggcaatgatattgccaactgtttgcggaagaacggcaaaagggtaatccagctgtcacgcaagactttcgacacggagtatcagaagaccaaaaataacgactgggattacgtggttacaactgacatatccgagatgggggctaatttccgtgcggatagagtgattgacccccggaggtgcctcaagccagtcatcctgaaagatggaccggaacgcgtgatccttgccggtcctatgcccgttaccgtggcaagtgctgcccagcgaagaggccggattgggaggaaccaaaataaggagggagaccagtacgtctatatgggccagccactaaacaatgatgaagaccacgcacattggacagaggccaaaatgctgttggataacatcaatacccccgagggtattatacctgctttatttgaaccagagcgcgaaaagagcgccgcgatcgacggggagtacagactgaggggcgaagcacggaagactttcgtggagctcatgcgtcgcggagatctgcccgtatggctttcgtataaagtggcctctgagggctttcagtactccgaccgaagatggtgcttcgatggggaaaggaacaatcaagttctggaggaaaacatggacgtcgagatttggacgaaggaaggagagcggaaaaagctccgccctagatggttggacgctaggacctatagcgatccgctggccctacgggagtttaaagagttcgctgcaggtcgaagatcagtgagtggcgacctgatcctcgagatcgggaaacttccacagcacctgacattacgcgcccagaatgctttggataacctggtgatgctccacaattctgaacagggaggcaaagcctacaggcatgcaatggaggaactgcccgacactattgagacccttatgctgctcgcgttgatagccgtcctgacaggtggggttaccttatttttcctatccggcaagggactgggcaagactagcatcgggctcctttgtgtgacagcttcaagtgccctgttgtggatggcaagcgtagagcctcactggattgctgcctccatcattctggaatttttcctcatggtgctgcttatccccgagccagatcggcaacgtacgcctcaggacaaccagctcgcatatgtcgtgataggactgttgtttatgatcctgaccgttgccgctaacgaaatgggtttactagagactaccaaaaaggatctgggcattgggcatgtggcggccgagaatcaccaacacgcaaccatgctcgacgtcgatcttagacccgcttctgcctggaccctgtacgccgtagcaacaactgtgatcacgccaatgatgaggcataccattgaaaacacaactgctaatatcagcttgaccgccatagcgaaccaggctgccattctgatgggactcgacaaaggctggcctatctccaagatggatattggtgttccgctgcttgcattagggtgctactcacaggtgaatcccctgacactcaccgccgctgtcttgatgctggtggcacactatgccatcataggcccaggactacaggcgaaagctactcgcgaggcccaaaagcggacggcagccggcatcatgaagaaccctacagtcgacgggattgtggctatcgatctggaccccgttgtgtacgacaccaaattcgaaaagcagctcggacagattatgcttctgatcttgtgtacttctcagatactgctcatgcgaaccacatgggccctgtgcgagagtattactttagcaaccggcccacttacaacgctgtgggaaggttcgcctgggaaattttggaataccactatcgctgtaagcatggccaacatcttcagaggatcctatctcgcgggcgccggtctagcattctctctgatgaagtcagtgggcgggggaaggcgcggcatgggggctcaaggagagacattgggcgagaaatggaagcggcagctgaatcagctcagcaagtccgaatttaacacctacaaaagaagtggtattatggaggtcgatcgttctgaagccaaggaggggcttaaaaggggagaaactacaaagcatgcagttagccggggcaccgctaaactgcgctggttcgtggagcgaaatttggtcaagcccgagggtaaggtgatcgacctgggctgtgggagaggaggctggtcatattactgcgccgggctcaaaaaggtaacggaagtgaaaggatataccaagggcggtccggggcacgaggaaccaatacctatggccacatacggatggaacttagttaaactgcattccggcaaggatgtgtttttcatgcccccagagaaatgtgacactcttctgtgcgatattggcgaaagtagccccaatcctaccatcgaggaggggaggacactacgggtcctcaagatggtggaaccgtggctgcgcggaaaccagttttgtattaagatcttgaatccctacatgccatctgtcgtggagactctggaacaaatgcagagaaaacacggtggcatgctcgttaggaaccctctttcccgaaattcaacccacgagatgtattgggtaagctgcgggacaggaaacatagtgtcggcggtcaacatgacctctcggatgctgttaaatcgtttcactatggctcatagaaagcccacgtacgagcgcgacgtggatctgggcgcaggtacaaggcacgttgccgtggaacctgaggtcgctaacttggacatcattgggcagcggatcgaaaatattaaaaacgagcataagagtacctggcactatgatgaagacaatccatacaaaacttgggcctatcacggatcctacgaggtgaagcccagcggctcagcatcctctatggtaaacggcgtggttagactcctgaccaagccttgggatgtcatcccaatggtgacacaaattgccatgacggacaccactccctttgggcagcagcgcgtgttcaaagagaaggtcgacacaaggaccccgcgagctaaacggggaactacacagatcatggaagttaccgcgaagtggctatggggttttcttagcagaaataaaaagcctaggatatgtacacgcgaggagttcactcgtaaggtgcggagtaacgccgcaattggcgctgtatttgtggatgagaatcaatggaactccgccaaagaagcagtcgaggacgagagattctgggatctggtgcatagggaacgcgagctccacaagcaggggaaatgcgctacctgcgtttataatatgatgggaaagcgagagaaaaagctgggcgagtttggtaaggccaaagggagccgggccatctggtacatgtggttgggagcgagattcctggagttcgaggcactcggctttatgaacgaggaccattggttctctagggaaaattcacttagtggcgtggagggggaaggactgcacaagttaggttacatcctgcgcgatatttccaaaataccaggcgggaacatgtatgccgacgatacggctggatgggacaccagaatcacagaggatgacttgcagaatgaggccaagattactgatatcatggaacccgagcatgcactcctggctaccagcatttttaaactaacataccagaacaaggtcgtgcgggtacaaaggcctgccaaaaacggcactgttatggacgtgatctctcgtcgagatcagcgcggttcggggcaggtcggaacctatggccttcacacgttcacaaatatggaagtgcagctgataagacaaatggagtcagaaggcatctttctcccaagcgagctggagacccccaacttggctgaacgggtgttagactggctggagaagcacggggccgaaaggctcaagcgcatggcaatttccggagacgattgtgtcgttaaaccgatcgacgatagattcgcgactgcccttacagctctgaatgacatgggtaaggtgcggaaagatattcctcagtgggagcccagtaagggctggaacgactggcagcaggtaccattttgctctcatcacttccatcaactaatcatgaaagatgggagggaaatagtggtcccttgtcgaaatcaggacgagctggtgggacgtgccagagttagccagggcgcaggttggtccctccgcgagaccgcttgcttggggaagtcatacgcccaaatgtggcagctgatgtattttcaccggagggatcttagactggcagccaacgcgatttgtagtgctgtgcccgtcgactgggtgccaacttctcgcaccacatggagcatccacgcccatcaccagtggatgacgaccgaagatatgctctccgtatggaatcgggtttggatcgaggaaaacccctggatggaggacaagactcatgtgtcaagctgggaagaggtcccttacttaggaaaaagggaggaccagtggtgcggctctctgattggcttgacagcacgagccacctgggctactaatatacaagtggccatcaaccaggttagacggctgattgggaatgaaaactatctcgattacatgacatccatgaagaggttcaaaaatgagagtgacccagaaggagcactttggtga

SEQ ID NO: 13227 - RNA, 9879 nt, synthetic construct
  misc_feature 1..9879: note = derived and/or modified CDS sequence (opt3) from DENV-1__FJ850070__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagttggtgtgaacatgtgcacactcattgcaatggacctgggcgagctttgtgaagatactatgacctacaaatgcccacggataacagaggccgaaccggacgatgtagactgttggtgcaatgcgaccgatacttgggtgacatatgggacctgtagtcaaacgggagagcaccgccgagacaagcgtagcgtcgctctggccccccatgtgggcttgggtctcgagactagaaccgaaacatggatgtcctctgagggggcatggaaacagatccagaaggttgaaacttgggccctgaggcaccctggattcaccgtgattgctctgtttctcgcacatgccatcggcacatcgattacccagaagggcatcatattcatcttactgatgcttgtcacgccatcaatggctatgcggtgcgtggggattggaaaccgcgattttgtagagggtttgagcggcgccacttgggttgacgtggtcctggagcacgggagttgtgtgacaaccatggcgaaaaataagcccactctagatatcgaactcctgaaaacagaggtgaccaaccctgcagtccttagaaagctgtgcattgaagccaaaatctccaatacgaccacagactctaggtgtccaactcaaggagaggctaccttggttgaagagcaggatgccaacttcgtgtgccggcgcacatttgtagaccgaggctggggtaatgggtgtggactcttcggcaagggcagcctgttaacttgcgcaaagtttaaatgcgtgaccaagctggaggggaaaatagtccagtacgaaaacctcaagtattccgtgattgttacagtgcacaccggagatcagcatcaagtcggtaatgagactacggaacacggcacaatcgctaccattactccccaggcccctacctcagagatccagcttacagactacggggcgctgaccttggactgtagtccaagaactggactagatttcaacgaaatggtgctgctcacaatgaaagagaagagctggctggtacataaacagtggtttcttgacctgccgttgccctggacgtctggcgcctccacctcacaagagacttggaataggcaggatctcctggttacattcaagaccgcacacgctaagaaacaggaagtggtcgtgttaggtagccaagagggggccatgcacacagctctgactggcgccaccgaaatccagacgagtggaaccacaactatttttgcaggccatctaaagtgccggctcaaaatggacaagctgacccttaaagggatgtcttatgtcatgtgtacaggatccttcaagttggagaaggaagtggccgagactcagcacggtaccgttctggtgcaggtaaaatacgagggcacggatgctccttgcaagataccattcctcacacaagacgaaaaaggggtcacccagaacggacgtctgatcactgcgaatcccattgtgacagataaggagaaacctgttaacatcgaaaccgagccaccctttggcgagagctatatagtggtcggtgcaggggaaaaggcccttaagctgtcgtggttcaaaaagggctcttccattggaaaaatgtttgaggctactgcccgcggcgcaagaaggatggccatcttgggggacaccgcttgggatttcggatcaatcggtggcctctttacaagtgtggggaagctgattcatcaggtattcggaacggcctacggcgtgttatttagcggtgtttcctggaccatgaaaatcgggattggcatactgctaacttggctcggactgaattctcggagcacatcacttagtatgacctgtatcgcagtcggcatggtgacattgtacctgggggtgatggtccaggcggactccggatgcgttattaactggaagggccgagaactcaagtgtggtagcgggatcttcgtgactaacgaggtgcacacctggacggaacaatataaatttcaggctgattctccgaagcgcctgtcagccgcaatcggaaaagcctgggaggagggcgtatgcggtattagaagtgctacaaggttagaaaatataatgtggaagcagatcagcaacgagctgaattacattcttttggaaaacgacatgaaattcaccgtcgtggttggcgacgccaatgggatcctcgcacagggaaagaaaatgattcggcctcaacccatggagcataagtattcctggaagtcttggggcaaagctaagatcataggggccgatatccagaacactacctttattatcgacggaccagatacacctgaatgtcccgacgatcagcgcgcgtggaatatttgggaggtggaggactacggcttcggtatctttactaccaacatatggctgaaactaagagattcgcacacacagatgtgcgaccacaggctgatgagcgccgctattaaggattccaaagcagtccatgccgacatggggtattggatcgaatcagagaagaatgaaacgtggaagctcgctcgtgccagtttcattgaggtgaaaacctgtatctggccaaagtctcacactctgtggagcaacggagttcttgaatccgagatgataatccccaaaatttacggcggtcctatctcacaacataattatcggccaggctacttcacacagaccgcagggccgtggcacttgggaaagctggagttagattttgacctctgcgaaggcactacagtggtagtcgatgagcactgcgggtaccgaggacccagcctgagaaccacgactgtgaccggcaaaattatccatgaatggtgttgcaggtcttgtacacttcctccactgcgcttccggggtgaggacgggtgctggtatggaatggagataagacccgtgaaggaaaaggaggaaaacttggtcaggtccatggttagtgcgggcagcggtgaggtggactctttttccctcggcattctgtgtgtatcaatcctaatcgaagaggtgatgcgcagtcgatggagccggaaaatgctgatgaccgggactctcgccgtcttcctgcttttgattatgggacagctgacatggaatgatttaatccgtctctgcattatggtgggcgctaacgcctcggacagaatggggatgggaaccacatacctggcacttatggctacttttaagatgaggcctatgttcgccgttggcctgctatttcgccggctcacctccagagaggtgctgttgctgacgataggtttatctctcgtcgcaagcgtggaactgccaaattcacttgaggaactgggggatggattggccatgggcatcatgatgctcaaactgctaacagacttccaaccccaccagctgtggaccactcttctcagtctgacctttattaggacatccttgtctctggattatgcttggaagactatggcgatggccttaagcatcgtttccctcttcccgctgtgtctttcaaccacgagccagaaaacaacctggctgcctgtgttgctcggcagttttgggtgcaagccactgactatgttcctaattacagagaacaagatctggggacgaaaatcttggcccataaacgaaggtatcatggcagtcggcattgtatccatcctgcttagctcgctcctgaagaatgacgtgcctttggctgggcccttaattgccggaggcatgctgatcgcctgttacgttatatcaggttctagtgctgatctctccctggagaaagcagccgaggtgagctgggaagaggaagcggagcattctgggaccagccacaacattcttgtcgaagtgcaggacgatggaactatgaagatcaaagacgaggagcgcgatgacacactgaccatcttgctaaaggctacgctgctcgccgcatccggcgtatatccaatgtcaattcctgccactctgtttgtgtggtacttctggcaaaaaaagaagcagcggagtggcgtcctttgggatacccccagcccaccggaagttgagagagctgtgttagacgacgggatatataggatcctgcagcgtggactcttgggtcgctctcaggtgggcgtcggggtgttccaagatggagtttttcatacaatgtggcacgtaacccggggcgcagtgctgatgtaccagggtaaaagactcgaaccttcctgggcctcagtcaagaaagacctgattagttacgggggaggctggaggttccagggcagctggaatacaggggaggaggtgcaggttatcgcggtggaacccggaaagaacccaaaaaatgtccaaactacccccggtacgtttaagacacctgagggcgaagtgggggctattgcccttgatttcaagccaggaacttccggctctcccatcgtaaaccgagagggtaaaatagtcgggctgtatggaaatggcgtggttaccacatcgggcacctacgtgagcgcaatcgcccaggctaaggcctcacaggaagggcctttgccggagattgaggacgaagtctttaaaaagcggaacctaactatcatggatctgcacccaggatccggtaaaacccgcagatatctccccgcaattgtgagggaggctatcaagcggaagttacgaacactgatacttgcccctacgagagttgtggcgagtgaaatggccgaggcactgaaaggcatgccaattcgctaccaaactaccgctgtcaagtctgaacatacagggagggagatcgtggacctcatgtgccacgccaccttcactatgcgtttgctgagccccgtacgggtgcctaattataacatgatcattatggatgaggctcattttacagacccggcatccatcgccgccagaggatacatatcaaccagggttggcatgggtgaagctgcggcaattttcatgacggccactcccccagggtctgtcgaggcttttcctcagagcaatgccgtgatccaggatgaagagcgcgacattcccgaacgaagttggaactccggatatgattggatcacagacttcccaggcaaaaccgtgtggtttgtccctagcataaagtctggcaatgacattgcaaactgtctcagaaaaaatgggaagcgggtaatccagctgtcaaggaagaccttcgatactgagtaccaaaaaacaaagaacaacgactgggattacgtggttaccacagacatctccgagatgggagccaatttccgcgctgatcgtgtgattgaccccagacggtgccttaaaccagtcatcctaaaggatggtccggaaagggtgattctggcgggccctatgcccgttactgtggccagtgcagctcagcgccgagggagaataggacggaaccagaataaagagggcgaccagtatatctacatgggtcaaccattgaacaatgatgaagaccacgcccattggacggaggcaaagatgttactggataacattaatacccccgaggggatcatccctgccctctttgaaccagagagggaaaagagcgctgccattgacggcgagtatcgcctgagaggagaagcgaggaaaacattcgtcgagcttatgcggcgtggcgatctgcccgtgtggctctcgtacaaggtagcatctgaggggtttcagtattccgaccgccgatggtgcttcgacggagaaagaaacaatcaggtgttggaggaaaacatggatgttgagatatggactaaagaaggtgagaggaagaaactgcggcctcgctggctagacgccagaacctacagcgatccgctggctctcagggagtttaaggaattcgccgctggccggcgatcagtcagtggggaccttatcctggagattggaaaattaccacagcacttgacactgagagcacaaaatgccctcgataacctggtgatgcttcacaattctgaacagggcggtaaggcttatcgccatgccatggaggaactgcccgacaccatcgagactctcatgttgctggcattaattgcggtgctaacggggggcgtcaccctgtttttcctctccggaaagggccttgggaaaacaagcatcggactgttgtgtgttatggcctcaagtgctctgctctggatggccagcgtggagcctcactggatagcagcttccatcattctggaatttttccttatggtactcctgatccccgagccagataggcagcggactcctcaggacaaccaattggcctacgtggtcattggtctgttatttatgatcctaaccgtggcagccaatgaaatgggcctgctcgagacaaccaagaaagatcttgggataggacatgttgctgcggagaaccaccaccatgccactatgctggacgtggatttgcaccccgcatctgcttggacactgtacgccgtcgccacgaccgtaattactccaatgatgcgtcatacaatcgaaaacaccaccgcaaatattagcctcacagctatcgccaaccaggcggctatactgatgggccttgacaagggttggcctatctccaaaatggatattggggtgccgttactggccctcggctgctattcacaggttaatcccttgactctgacggcagccgtgctaatgctggtcgctcactacgcaatcattggaccaggcctccaagccaaggcgaccagagaggctcagaagaggacagccgcagggatcatgaaaaaccctactgtggacggaatagtcaccattgaccttgatcccgtggtttatgacgccaagttcgaaaaacagctgggccagatcatgttgctgatcctctgtacatctcaaattctgttaatgcgcaccacttgggctctttgcgagagtatcacgctggccacaggtccactcaccactctatgggaagggtcgcctggaaagttttggaataccacaatagcagtgagcatggctaacattttccggggctcctacctggccggtgcgggcttggccttctctctgatgaaatcactcgggggaggccgaagagggactggagcacagggcgagacccttggtgagaagtggaagaggcagctgaatcagttgagcaaatccgaatttaacacatataagaaaagtgggatcatggaggtagatcgctctgaagctaaggagggactgaaacggggcgaaacgaccaagcatgccgtgagcagaggtactgcaaagctccgttggttcgtcgagaggaatttagttaaacccgagggcaaggtgattgacctggggtgtggacggggcgggtggtcatactattgcgctggacttaaaaaggtcacagaagtgaaaggctacaccaagggtgggccgggacacgaggaaccaatccctatggccacttacggctggaacctggtaaaactacactccggcaaggatgtgtttttcacacccccagagaagtgtgacaccctcctgtgcgatataggggaaagtagccccaatcctacgatcgaggagggacgcaccttgcgagttctgaaaatggtggaaccgtggctcagaggtaaccaattttgtattaagatccttaatccctatatgccatctgtcgtggagacactggaacagatgcagaggaaacatggcgggatgttagtccggaaccctctgtcccgcaattcaactcacgagatgtactgggtgagctgcggaaccggcaacattgtttcggccgtaaatatgacatctagaatgttgctcaacaggttcactatggcgcatcgaaagcccacctatgagcgggacgtggatctgggtgctgggacacgtcacgtcgcagtggaacctgaggttgccaacctagacatcattggacagagaatcgaaaatataaaaaacgagcacaagagtacctggcattacgatgaagacaatccatataagacttgggcttaccacggctcctatgaggtgaaaagctcaggctccgcctctagcatggtcaacggggtggtacgccttctgacgaagccctgggacgtgattcctatggttacacaaatcgcaatgaccgatactaccccatttggacagcagagggtcttcaaagagaaggtggacacacggacgcccagagccaaacgcggtaccgctcaaatcatggaagtgactgcgaagtggctctggggctttctgagtaggaataagaaaccgcgaatttgtacacgggaggaattcaccagaaaggtcaggtccaacgccgcaataggggctgtttttgtggatgagaatcagtggaacagcgccaaagaagcagtagaggacgagcgcttctgggatttggtgcatcgtgaacgggagctgcacaagcagggaaaatgcgccacttgcgtctacaatatgatgggcaagagagaaaagaaactcggtgagtttgggaaggctaaaggatctagggccatctggtacatgtggcttggcgcgcgcttcctggaattcgaggcattaggctttatgaacgaggaccattggttctcacgagaaaatagtctgtccggggtggagggagaaggtttgcacaagctcggctatattctgcgggatatcagcaaaattcctgggggaaacatgtacgccgacgatacagctggctgggacaccagaatcacagaggatgacctacagaatgaggccaagataactgatatcatggaaccagagcacgcacttctggctacctctatttttaaactcacgtatcaaaacaaggttgtgagggtccagcgccccgccaagtcgggtaccgtgatggacgtaatctcaagacgggaccagagggggagcggacaggttggcacatacggcctgaatactttcaccaacatggaagtgcaattgattcgtcagatggagtccgaagggatctttagtccttctgagttagagacaccaaacctggctaaacgagtcctcgattggcttgaaaagcatggagccgagcgcctgaaaagaatggcaataagcggtgacgattgtgtggtgaagcccattgacgatcggttcgcgactgccctaaccgctctgaatgacatgggcaaagtcaggaaggatatcccgcagtgggaaccttccaaggggtggaacgactggcagcaagttcccttttgctcacaccatttccaccagctcatcatgaaagatggacgcgagattgtggtaccatgtagaaatcaggacgaattggtgggccgggccagggtcagtcagggtgcagggtggtctctgcgagagacggcttgccttggaaagagctatgcccaaatgtggcagctgatgtactttcaccgtagagatctccgcttagcagccaacgcgatatgttccgctgtgcctgttgactgggtgcccacatcacggaccacttggagcatccatgcccaccatcagtggatgacaaccgaggacatgctgtctgtctggaatagggtgtggattgaagagaacccatggatggaagataaaactcacgtatccagttgggaggaagttccctatttgggcaagagagaggaccaatggtgcggcagcctgatcgggctcaccgcacgcgccacatgggctacgaatattcaggtggccatcaaccaggtccggaggcttataggaaatgagaactacctggattacatgacctcgatgaaacgattcaagaatgaatccgaccctgagggtgcactatggtga

SEQ ID NO: 13228 - RNA, 9879 nt, synthetic construct
  misc_feature 1..9879: note = derived and/or modified CDS sequence (opt3) from DENV-1__FJ850071__SS-prME
  source 1..9879: mol_type = other RNA
agcgtgacaatgctgctcatgcttctgcccacggccttggctttccacttaactacgagaggcggggaacctcatatgatcgtctccaagcaggaaagaggaaaatctctgctgtttaagacctcagttggtgtgaacatgtgcacactcattgccatggacctgggcgaactttgtgaagatactatgacctacaaatgcccacggataacagaggccgaaccggacgatgtagactgttggtgcaatgcgaccgatacttgggtgacatatgggacctgtagtcaaacgggagagcaccgccgagacaagcgtagcgtcgctctggcaccccatgtgggcttgggtctcgagactagaaccgaaacatggatgtcctctgagggggcatggaaacagatccagaaggttgaaacttgggccctgaggcaccctggattcaccgtgattgctctgtttctcgcacatgccatcggcacatcgattacccagaagggcatcatattcatcttactgatgcttgtcacgccatcaatggctatgcggtgcgtggggattggaaaccgcgattttgtagagggtttgagcggcgccacttgggttgacgtggtcctggagcacgggagttgtgtgacaaccatggcgaaaaataagcccactctggatatcgaactcctgaaaacagaggtgaccaaccctgcagtccttagaaagctgtgcattgaagccaaaatctccaatacgaccacagactctaggtgtccaactcaaggagaggctaccttggttgaagaacaggatgccaacttcgtgtgccggcgcacatttgtagaccgaggctggggtaatgggtgtggactcttcggcaagggcagcctgttaacttgcgcaaagtttaaatgcgtgaccaagctggaggggaaaatagtccagtacgaaaacctcaagtattccgtgattgttacagtgcacaccggagatcagcatcaagtcggtaatgagactacggaacacggcacaatcgctaccattactccccaggcccctacctcagagatccagcttacagactacggggcgctgaccttggactgtagtccaagaactggactagatttcaacgaaatggtgctgctcacaatgaaagagaaaagctggctggtacataaacagtggtttcttgacctgccgttgccctggacgtctggcgcctccacctcacaagaaacttggaataggcaggatctcctggttacattcaagaccgcacacgctaagaaacaggaagtggtcgtgttaggtagccaagagggggccatgcacacagctctgactggcgccaccgaaatccagacgagtggaaccacaactatttttgcaggccatctaaagtgccggctcaaaatggacaagctgacccttaaagggatgtcttatgtcatgtgtacaggatccttcaagttggagaaggaagtggccgagactcagcacggtaccgttctggtgcaggtaaaatacgagggcacggatgctccttgcaagataccattcctcacacaagacgaaaaaggggtcacccagaacggacgtctgatcactgcgaatcccattgtgacagataaggagaaacctgttaacatcgaaaccgagccaccctttggcgagagctatatagtggtcggtgcaggggaaaaggcccttaagctgtcgtggttcaaaaagggatcttccattggaaaaatgtttgaggctactgcccgcggcgcaagaaggatggccatcttgggggacaccgcttgggatttcggatcaatcggtggcctctttacaagtgtggggaagctgattcatcaggtattcggaacggcctacggcgtgttatttagcggtgtttcctggaccatgaaaatcgggattggcatactgctaacttggctcggactaaattctcggagcacatcacttagtatgacctgtatcgcagtcggcatggtgacattgtacctgggggtgatggtccaggcggactccggatgcgttattaactggaagggccgagaactcaagtgtggtagcgggatcttcgtgactaacgaggtgcacacctggacggaacaatataaatttcaggctgattctccgaagcgcctgtcagccgcaatcggaaaagcctgggaggagggcgtatgcggtattagaagtgctacaaggttagaaaatataatgtggaagcagatcagcaacgagctgaattacattcttttggaaaacgacatgaaattcaccgtcgtggttggcgacgccaatgggatcctcgcacagggaaagaaaatgattcggcctcaacccatggagcataagtattcctggaagtcttggggcaaagctaagatcataggggccgatatccagaacactacctttattatcgacggaccagatacacctgaatgtcccgacgatcagcgcgcgtggaatatttgggaggtggaggactacggcttcggtatctttactaccaacatatggctgaaactaagagattcgcacacacagatgtgcgaccacaggctgatgagcgccgctattaaggattccaaagcagtccatgccgacatggggtattggatcgaatcagagaagaatgaaacgtggaagctcgctcgtgccagtttcattgaggtgaaaacctgtatctggccaaagtctcacactctgtggagcaacggagttcttgaatccgagatgataatccccaaaatttacggcggtcctatctcacaacataattatcggccaggctacttcacacagaccgcagggccgtggcacttgggaaagctggagttagattttgacctctgcgaaggcactacagtggtagtcgatgagcactgcgggtaccgaggacccagcctgagaaccacgactgtgaccggcaaaattatccatgaatggtgttgcaggtcttgtacacttcctccactgcgcttccggggtgaggacgggtgctggtatggaatggagataagacccgtgaaggaaaaggaggaaaacttggtcaggtccatggttagtgcgggcagcggtgaggtggactctttttccctcggcattctgtgtgtatcaatcctaatcgaagaggtgatgcgcagtcgatggagccggaaaatgctgatgaccgggactctcgccgtcttctttctgcttattatgggacagttgacatggaatgatctgatccgtttatgcattatggtgggcgctaacgcctcggacagaatggggatgggaaccacatacctcgcactgatggctactttcaagatgaggcctatgtttgccgttggccttctgttccgcaaactaacctcccgggaggtgctcctgttgacgataggtctgtctttagtcgcaagcgtggaactcccaaattcactggaggaacttggggatggactggccatgggcatcatgatgttgaagctcctgacagactttcaaccccaccagctatggaccactctgcttagtctcaccttcattagaacatccctgtctttggattatgcttggaaaactatggcgatggccctgagcatcgtttccttatttccgctctgtctgtcaaccacgagccagaagacaacctggcttcctgtgctgttgggcagtttcgggtgcaagccactcactatgtttctgattacagagaacaaaatctggggaaggaagtcttggcccataaacgaaggtatcatggcagtcggcattgtatccatcctactgagctcgcttctcaaaaatgacgtgcctctggctgggcccttgattgccggaggcatgttaatcgcctgttacgttatatcaggttctagtgctgatctgtccctcgagaaggcagccgaggtgagctgggaagaggaagcggagcattctgggaccagccacaacattctggtcgaagtgcaggacgatggaactatgaaaatcaaggacgaggagcgagatgacacacttaccatcctgttgaaagctacgctactggccgtatccggcgtgtatccaatgtcaattcctgcaactctcttcgtctggtacttctggcaaaagaagaaacagcgcagtggcgttctgtgggatacccccagcccaccggaagtggagcgggccgtgcttgacgacgggatatatagaatcttacagaggggactgctcggtcgttctcaggtcggcgtgggggtttttcaagatggagtattccatacaatgtggcacgtgacccgcggcgctgtcttgatgtaccagggtaagcggctggaaccttcctgggcatcagtgaaaaaggacctcattagttacgggggaggctggagatttcagggcagctggaatacaggggaggaggttcaggtgatcgccgtcgaacccggcaaaaacccaaagaatgtgcaaactacccccggtacgttcaagacacctgagggcgaagtaggggcgattgctctggattttaaaccaggaacttccggctctcccatcgtcaacagggagggtaagatagtggggctttatggaaatggcgttgtgaccacatcgggcacctacgtcagcgccatcgcacaggccaaggcttcacaggaagggcctctgccggagattgaggacgaagtgttcaagaaacgaaacttgactatcatggatctacacccaggatccggtaagacccggcgctatctgcccgccattgttagagaggcaatcaagaggaaactccggacattaatactggctcctacgcgagtggtcgccagtgaaatggcggaggcccttaagggcatgccaattagataccaaactaccgcagtgaaatctgaacatacagggcgcgagatcgtagacctgatgtgccacgctacctttactatgaggctcttgagccccgtgcgtgttcctaattataacatgatcattatggatgaggcccatttcacagacccggcttccatcgcagcccggggatacatatcaaccagagtcggcatgggtgaagccgctgcgatttttatgacggcaactcccccagggtctgtggaggccttccctcagagcaatgctgtgatccaggatgaagagagggacattcccgaacgcagttggaactccggatatgattggatcacagactttccaggcaagaccgtctggttcgtacctagcataaaatctggcaatgacattgccaactgtctgcgaaagaatgggaagagagtgatccagctctcacggaaaaccttcgatactgagtaccaaaagaccaaaaacaacgactgggattacgttgtgaccacagacatctccgagatgggagcaaattttagggccgatcgcgtcattgacccccgtagatgcctgaagccagtgatccttaaagatggtccggaacgggttattctagctggccctatgcccgtgactgtcgcgagtgccgcacagaggcgcgggcgaataggaagaaaccagaataaggagggcgaccagtatatctacatgggtcaaccactgaacaatgatgaagaccacgctcattggacggaggccaagatgttgttagataacattaatacccccgaggggatcatccctgcactgttcgaaccagagcgggagaaaagcgccgctattgacggcgagtataggctccgcggagaagccagaaagacatttgtggagctgatgaggcggggcgatcttcccgtatggctgtcgtacaaagtggcgtctgaggggttccagtattccgaccgtcgctggtgctttgacggagaacgaaacaatcaggttctcgaggaaaacatggatgtcgagatatggactaaggaaggtgagaggaaaaagttgaggcctcggtggctggacgcacgcacctacagcgatccgctagccctgagagagttcaaagaatttgctgccggcaggcggtcagtgagtggggacctcatccttgagattggaaagctgccacagcacttaacattgcgagctcaaaatgcactggataacctcgtgatgctgcacaattctgaacagggcggtaaggcctatagacatgctatggaggaacttcccgacaccatcgagactctgatgctcttggccctgattgcagtcttaacagggggcgttaccctattctttctgtccggaaaaggcctcgggaagacaagcatcggacttctgtgtgtgatggcgtcaagtgccttgctgtggatggctagcgtagagcctcactggatagccgcatccatcattctcgagttctttctgatggtgcttctcatccccgagccagatcgccagaggactcctcaggacaaccaactggcttacgtcgtgattggtttgctgttcatgatcttaaccgttgccgcaaatgaaatgggcctactggagacaaccaaaaaggatctcgggataggacatgtggccgctgagaaccaccaccatgcgactatgcttgacgtcgatctgcggcccgcctctgcatggacattgtacgctgtagccacgaccgtgattactccaatgatgcgtcacacaatcgaaaacaccaccgccaatattagcctgacagcaatcgctaaccaggccgcgatactcatgggcctggacaaaggttggcctatctccaagatggatattggggttccgcttttagctctgggctgctattcacaggtgaatcccctcactttgacggccgcagtcctgatgctagtggcccattacgctatcattggaccaggcctgcaagcaaaggccaccagagaggcgcagaaaaggacagctgccgggatcatgaagaaccctactgtcgacggaatagtgaccattgacctcgatcccgttgtgtatgacgcaaaatttgaaaagcagcttggccagatcatgctgttgatcctgtgtacatctcaaattctcctgatgcgcaccacttgggccttatgcgagagtatcacgcttgctacaggtccactgaccactctctgggaagggtcgcctggaaaattctggaataccacaatagccgtaagcatggcaaacattttccggggctcctacctagctggtgccggcctggcgttttctttgatgaagtcactagggggaggccgaagagggactggagcccagggcgagaccctcggtgagaagtggaaaaggcagcttaatcagctgagcaagtccgagttcaacacatataaaaagagtgggatcatggaggtggatcgctctgaagcaaaagagggattgaagcggggcgaaacgaccaagcacgctgtcagcagaggtactgccaaactgcgttggtttgttgagaggaatctcgtgaagcccgagggcaaagtcattgacttagggtgtggacggggcgggtggtcatactattgcgcaggactgaagaaagtgacagaagtaaagggctacaccaaaggtgggccgggacatgaggaaccaatccctatggctacttacggctggaaccttgtgaagctgcactccggcaaggatgttttctttacacccccagagaaatgtgacaccctactctgcgatataggggaaagtagccccaatcctacgatcgaggagggacgcaccctgcgagtgttgaagatggtcgaaccgtggctgagaggtaaccaattctgtattaaaatcctcaatccctatatgccatctgtggtcgagacacttgaacagatgcagaggaagcacggcgggatgctggtgcggaaccctttatcccgcaattcaactcatgagatgtactgggttagctgcggaaccggcaacattgtatcggccgtgaatatgacatctagaatgctgttgaacaggtttactatggcccaccgaaaacccacctatgagcgggacgtcgatctcggtgcggggacacgtcatgtggctgttgaacctgaggtggcaaacctggacatcattggacagagaatcgaaaatataaagaacgagcacaagagtacctggcactacgatgaagacaatccatataaaacttgggcctaccatggctcctatgaggtcaagcccagcggctcagcttcctctatggtgaacggggtagtgcgcctacttacgaaaccttgggacgttattccaatggtcacacaaatcgccatgaccgatactacccccttcggacagcagagggtgtttaaggagaaagtggacacacggacgccgagagcaaagcgcggtaccgcccaaatcatggaagtcactgctaagtggctgtggggcttcctcagcaggaataaaaagcctcgaatttgtacacgggaggaatttaccagaaaagttaggagtaacgcggccataggggcagtgttcgtagatgagaatcagtggaactccgctaaggaagccgtggaggacgagcgcttttgggatctggtccaccgtgaacgggagttgcataaacagggaaagtgcgcaacttgcgtgtacaatatgatgggcaagagagagaaaaagctgggtgagttcgggaaagccaagggaagcagggctatctggtacatgtggctcggcgcccgcttccttgaatttgaggcgctgggcttcatgaacgaggaccactggttttctcgagaaaattcattaagtggggttgagggagaaggtctgcataaattgggctatattctccgggatatctccaagattccagggggaaacatgtacgcagacgatacagccggctgggacaccagaatcacagaggatgacctgcagaatgaggctaaaataactgatatcatggaacccgagcacgccctacttgcaaccagcattttcaagctgacgtatcaaaacaaggtggtcagggtgcagcgccctgctaaatctggtaccgtaatggacgttatctcgagacgggaccagagggggtcaggacaggtgggcacatacggcctcaatacttttaccaacatggaagtccaactgattcgtcagatggagagcgaagggatcttctccccaagtgagttggagacacccaacttagccaagcgagtgctggattggctcgaaaaacacggagctgagcgccttaagagaatggccatatctggtgacgattgtgtggtcaaaccgattgacgatcggtttgcaactgcgctgaccgccctaaatgacatgggcaaggttaggaaggatatccctcagtgggaacccagcaaagggtggaacgactggcagcaagtgccattctgctcccatcactttcatcagctgatcatgaaggatggacgcgagattgtagtgccttgtagaaatcaggacgaactcgtcggccgggctagggtgtcacagggtgccgggtggagtttgcgagagacggcatgcctgggaaaatcttatgctcaaatgtggcagcttatgtacttccaccgtagagatctgcgcctcgccgcaaacgccatatgtagcgcggttcccgtggactgggtcccaacatcccggaccacttggtcaatccacgctcatcaccagtggatgacaaccgaggacatgttaagcgtgtggaatagggtatggattgaagagaacccctggatggaagataagactcatgtttcttcctgggaggaagtgccttatctgggcaaaagagaggaccaatggtgcggcagtttgatcgggctgaccgcccgcgcaacatgggccacgaatattcaggtcgctatcaaccaggtgcggaggctcataggaaatgagaactaccttgattacatgaccagcatgaagcgatttaagaatgaatcggacccagagggtgccctgtggtga

SEQ ID NO: 13229 - RNA, 9879 nt, synthetic construct
  misc_feature 1..9879: note = derived and/or modified CDS sequence (opt3) from DENV-1__FJ850073__SS-prME
  source 1..9879: mol_type = other RNA
agcgtgaccatgctgctcatgcttctgcccactgcattggctttccacttaactacgagaggaggggagcctcatatgatcgtctccaagcaagaaaggggaaaatctctgctatttaagacctcagccggtgttaacatgtgcactctcattgcaatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaaacagatccagaaggtggaaacttgggctctgaggcaccctggattcaccgttattgcactgtttctcgcccatgctatcggcacatcgattacccagaagggcatcatattcatcttactgatgcttgtgacgccatcaatggccatgcggtgcgtcgggattggaaaccgcgattttgtggagggtttgagcggcgcgacttgggtagacgttgtgctggagcacgggagttgtgtcacaaccatggccaagaataagcccactctagatatcgaactcctgaaaacagaggtgaccaaccctgccgtgcttagaaagctgtgcattgaagctaaaatctccaatacgaccacagactctaggtgtccaactcaaggagaggccaccttggtcgaagaacaagatgcaaacttcgtttgccggcgcacatttgtggaccgaggctggggtaatgggtgtggactcttcggcaagggcagcctgttaacttgcgctaagtttaaatgcgtaaccaagctggaggggaaaatagtgcagtacgaaaacctcaagtattccgtcattgtgacagttcacaccggagatcagcatcaagtgggtaatgagactacggaacacggcacaatcgccaccattactccccaggcgcctacctcagagatccagcttacagactacggggccctgaccttggactgtagtccaagaactggactagatttcaacgaaatggtcctgctcacaatgaaagaaaagagctggctggtgcataaacagtggtttcttgacctgccgttgccctggacgtctggcgcatccacctcacaagagacttggaataggcaggatctcctggtaacattcaagaccgctcacgccaagaaacaggaagttgtggtcttaggtagccaagagggggctatgcacacagccctgactggcgcaaccgaaatccagacgagtggaaccacaactatttttgccggccatctaaagtgccggctcaaaatggacaagctgacccttaaagggacatcttatgtgatgtgtactggatccttcaagttggagaaggaagtcgctgagacccagcacggtacggtgctggttcaggtgaaatacgagggcacagatgcgccttgcaagataccattcagcacccaagacgaaaaaggggtaactcagaacggacgtctcatcacagcaaatcccattgtcaccgataaggagaaacctgtgaacatcgaaactgagccaccctttggcgagtcgtatatagttgtgggtgccggggaaaaggctctgaaactttcttggttcaaaaagggctcctcaattggaaaaatgtttgaggccaccgcacgcggcgccagaaggatggctatcctgggggacacagcctgggatttcggaagtatcggtggcgtctttacgagcgtggggaagttggtacatcaggtgttcggaaccgcatacggcgttctcttttccggtgtctcttggactatgaaaattgggatcggcattctgttaacatggctgggactaaatagccggtcaaccagtctctccatgacatgtatagcggtgggcatggtgactctgtaccttggggtcatggttcaggctgacagcggatgcgtgatcaactggaagggccgagaattgaagtgtggttctgggattttcgtgaccaacgaggtacacacgtggacagaacaatataaatttcaggccgattcaccgaagcgcctgagtgcagccatcggacgagcttgggaggagggcgtctgcggtatcaggagcgccacccggctcgaaaatattatgtggaaacagatatccaacgagctgaatcatatcttactggaaaacgacattaagttcactgtggttgtgggcaatgcagacgggatccttgctcagggcaaaaagatgattcgccctcaacccatggagcacaaatactcttggaagtcgtggggcaaggccaaaatcataggggcggatatccagaacaccacatttattatcgacggaccagatactttggaatgtcctgacgagcagagagcctggaatatttgggaggtcgaagattatggcttcggtatctttaccacaaacatatggctcaagctgagggacagctacacgcagatgtgcgatcaccgtctaatgtccgctgcaattaaagactcaaaggccgtgcatgctgatatggggtattggatcgagagtgagaaaaatgagacctggaagctggcccgggcatctttcattgaagttaagacttgtatctggcccaaaagccacacactctggtccaacggagtgctggagtcagagatgataatcccaaagatgtacggcggtcccgtaagccaacataattatcgacctggctacttcacccagactgcggggccatggcaccttggaaaattggaactggactttgatttatgcgagggcacaaccgtcgtggtggacgaacactgcgggtctagaggaccgtccctcaggacgactaccgtcacaggcaagattatccatgagtggtgttgccgcagttgtaccctgccccctcttcggttcagaggtgaggatgggtgctggtacggaatggaaattaggccagttaaagagaaggaagagaacctggtgcgcagcatggtatctgccggctccggtgaagtggactcatttagtttgggcgtcctctgtgtgagcatcatgatagaggaggttatgcgatcgcggtggtcccgtaagatgctgatgactgggacactagctgtgttcctgctcctgattatgggacagcttacctggaatgacttgatcagactgtgcatcatggtcggcgccaacgcatctgataaaatggggatgggaacaacttatttagctctcatggccacctttaagatgaggcccatgttcgcagtgggcctgctttttcgccggctgacgagcagagaagttctactcctgacaattggtttgtcactggtggccagtgtcgagttacctaattccctcgaggaactgggggacggacttgctatgggcatcatgatgctgaaattgctcaccgagttccaaccacaccagctgtggactaccctactgtctcttacatttattaagactaccctcagcctggattacgcgtggaaaacgacagccatggtattgtccatagtgtcactgttccccttatgtctcagcaccacaagtcagaagacaacctggctgccggttcttctgggctcttttgggtgcaagcctttgactatgttcctcatcacagagaacgagatttggggaaggaaatcctggccactgaacgaaggtatcatggcaattggcatcgtgagcatactactgtcgtcacttctcaagaatgacgtccccctggctgggcctttgatcgccggaggcatgttaattgcctgttatgtgatctctggtagttccgctgatctgagcctcgagaaagcagccgaagtatcttgggaggaagaggtggagcatagcgggacctcccacaacattctggtcgaagttcaggacgatggaacgatgaagatcaaagacgaggaacgagatgacactcttaccatactgttgaaggcgacactactggctgtgtcaggcgtgtaccccatgagtattccagccaccctctttgtctggtatttctggcagaaaaagaagcagcgcagcggcgtgctgtgggatacaccttctcccccagaggttgagcgggcagtacttgacgatgggatctacagaatcttacagaggggactgctcggtcgttcccaggtgggcgtcggggtgttccaagacggagtttttcatactatgtggcacgtgacccgcggcgccgtcttgatgtatcagggtaaacggctggaaccgtcatgggctagtgtgaagaaagacctcattagctacgggggaggctggagattccagggctcctggaatacgggggaggaagtacaggtcatagcagtggagcctggaaagaaccccaaaaatgttcaaacaactccaggtacctttaagacacccgaaggcgaggtgggggccatcgcgctggatttcaagcctggaacctctggctcgccaattgtcaacagggagggtaaaatcgtggggctttacggaaatggcgttgtgactaccagcggcacatatgtctcagctattgcccaggcaaaggcctcccaggaagggcccctgcctgagatcgaagacgaggtgtttaaaaagcgaaacttgacgataatggatctacacccgggaagtggtaaaactcggcgctacctgccagctatcgtaagagaagccattaagaggaagctccggaccttaatcctggcacccacacgagtggttgcttctgagatggccgaggcgcttaaaggcatgcctattagatatcaaaccactgccgtcaagagcgaacatacagggcgcgagatcgtggacctgatgtgccacgcaaccttcacgatgaggctcttgtccccagtgcgtgtccccaattacaacatgataattatggatgaagctcattttactgaccctgcctcaatcgctgcacggggatatatctctacaagagtaggcatgggtgaggccgccgctattttcatgaccgcgaccccgcccgggagcgtggaagcatttccacagagtaatgccgttatccaggatgaggagagggacatacctgaacgctcctggaacagcggatacgattggattactgacttccccggcaaaacagtgtggtttgtcccatctatcaagtcaggcaatgatattgctaactgtctgcggaaaaatgggaagagagtgatccagctctccagaaagaccttcgacacagagtatcagaaaactaagaacaacgactgggattacgttgtgacgaccgacataagtgaaatgggagccaatttcagggcagatcgcgtcattgaccctcgtagatgcctgaaacccgtgatccttaaggatggtccagagcgggtaatcctagccggcccgatgcctgtgacagttgctagcgcggcccagaggcgcgggcgaattggaagaaaccagaataaagagggcgaccagtacgtctatatgggtcaacccctgaacaatgatgaagaccacgcacattggactgaggctaagatgttgttagataacatcaataccccagaagggattatacccgccctgtttgagcctgaacgggagaagtcggcagccatcgacggcgagtacaggctccgcggagaagctagaaaaacattcgtggagctgatgaggcggggcgatcttccagtgtggctgtcttataaggtcgcctccgaagggtttcagtacagcgaccgtcgctggtgcttcgatggagagcgaaacaatcaggttctcgaagagaacatggacgtggagatttggaccaaagaaggtgagagaaagaaattgaggccccggtggctggacgcgcgcacttattcagatcctctagcactgagagaatttaaggagttcgccgctggcaggcggagtgtatctggggacctcatccttgaaatcggaaaactgccgcagcacttaacgttgcgagcccaaaatgctctggataacctcgtgatgctgcacaattccgagcagggcggtaaggcatacagacatgccatggaggaacttccagacaccattgagacactgatgctcttggctctgatggccgtcttaactgggggcgtgaccctatttttcctgagcggaaagggcctcgggaaaacatcaataggacttctgtgtgttatggcaagtagcgcgttgctgtggatggcctccgtggaaccccactggatcgctgcctctattatcctcgagtttttcctgatggtccttctcattcctgagcccgatcgccagaggaccccacaggacaaccaactggcatatgtagtgatcggtttgctgtttatgatattaactgttgctgccaatgaaatgggcctactggagacaacgaagaaagatctcgggatcggacatgtggcagccgaaaaccaccagcacgctaccatgcttgacgtcgatctgcatcctgcgagcgcctggactttgtacgcagtggctacaaccgtcattacccccatgatgcggcacacaatcgagaacactacggccaatatttccctgaccgccatcgcaaaccaggctgccatactcatgggcctggacaagggttggccaatttcaaaaatggatcttggggtgcctttactggcgctcggctgctactctcaagttaatccgttgacactgactgctgccgtgctaatgctggtagcacattatgccatcattggacccggcctccaggctaaggcaacccgtgaagcccagaagagaacagcggctgggatcatgaaaaacccaaccgtggacggaatagtcgccatcgatcttgaccctgttgtgtacgacgcaaagttcgagaaacagctgggccaaattatgttgctgatcctctgtacgagtcagattctgttaatgaggactacatgggccctttgcgagtcgatcaccctggctactggtcccctcaccacactatgggaagggagcccaggaaagttttggaatactaccatagccgtctccatggcaaacattttccgcggctcttatctggctggtgccggcttggcgttctcactgatgaaaagcctcgggggaggccggcgagggacaggagcccagggcgagacgcttggtgaaaagtggaagagacagctgaatcaattgtccaaaagtgagtttaacacctacaagaggtctgggatcatggaagtggatcgcagcgaggcaaaagagggactgaagcggggcgaaactacaaaacacgctgtatcaagaggtaccgccaagctccgttggttcgtggagaggaatttagttaagcctgaaggcaaagtgatcgacctggggtgtggacggggcgggtggtcctattactgcgcaggacttaagaaagtcactgaggtgaagggctatacaaaaggtgggcccggacatgaagaaccgattccaatggctacctacggctggaacctggtcaagctacacagtggcaaagatgtgtttttcatgcctcccgagaagtgtgacacgctcctgtgcgatatcggggaaagctctccaaatcccaccatagaggaaggacgcacattgcgagttctgaagatggtagagccttggctcagaggtaaccagttttgtattaaaatccttaatccgtacatgccctccgtggtcgagactctggaacagatgcagaggaagcacggcgggatgttagtgcggaacccactgtcacgcaatagcacccatgagatgtattgggtttcgtgcggaacaggcaacattgtgtctgccgtcaatatgacaagtagaatgttgctcaacaggttcaccatggcccaccgaaaacctacatacgaacgggacgtggatctgggtgcggggacccgtcatgtagctgtggagcccgaagttgcaaacctagacatcataggacaaagaatcgagaatattaagaacgagcacaaatccacttggcactatgatgaagacaatccttacaagacgtgggcctatcatggcagctacgaggtcaagccatcaggctccgcttctagcatggtgaacggggtggtccgccttctgacaaaaccctgggatgttatccctatggtgacccagattgccatgactgacaccacaccatttggacagcaaagggtattcaaggaaaaagtggacacgcggacccccagagcaaagcgcggtactgcccagatcatggaggtcacagctaaatggctctggggctttctgagtaggaataagaagccgcgaatttgtacccgggaagagttcactagaaaagtgaggtccaacgcggccatcggggcagtttttgtggatgagaatcagtggaacagcgctaaggaagccgtcgaggacgaacgcttctgggatttggtgcaccgtgagcgggaactgcataaacagggaaagtgcgcaacatgcgtatataatatgatgggcaaaagagagaagaagctcggtgagtttgggaaagccaagggatctagggctatatggtacatgtggcttggcgcccgcttcctggagttcgaggcgttaggctttatgaacgaagaccactggttctcacgagagaatagtctgtccggggttgagggagaaggtttgcataaactcggctacattctgcgggatatcagcaagatccctgggggaaacatgtatgcagacgataccgccggctgggacacaagaattactgaggatgacctaaggaatgaagctaaaataaccgatatcatggagccagaacacgcccttctggcaacgtctatttttaagctcacctaccaaaacaaagtggtccgcgtgcagagacccgctaagaatggtacagtgatggacgtcatctcgcggagggatcagcgtgggtcaggacaggttggcacttatggcctgaacaccttcacaaacatggaggtgcaattgattcgacagatggagagcgaagggatctttttctccagtgagttagaatctcctaatctggccgagcgcgtactcgactggcttgaaaagcacggagctgagagactgaaacggatggccataagcggtgacgattgtgtggtcaagccaatcgacgataggtttgcaactgcgctaattgccctgaacgacatgggcaaagtgcgcaaggatatcccccagtgggagccgtccaaagggtggaatgactggcagcaagttcctttctgctcacatcactttcatcagctcattatgaaggatggaagagaaatcgtggtcccctgtcggaaccaggacgagttggtgggcagggctcgagtaagtcagggtgccgggtggtctctgcgtgaaaccgcatgccttggaaagagctacgctcaaatgtggcagctgatgtatttccacagacgcgatctccggttagccgcaaatgccatatgttccgcggttccagtggactgggtccctacgtcaaggacaacctggagcattcacgctcatcaccagtggatgactacagaggatatgctgtctgtgtggaacagagtttggatcgaagagaatccctggatggaggacaaaacccatgtgtccagttgggaagaggtcccatacttgggcaagcgcgaagaccaatggtgcggcagcctgatcgggctcactgcccgggcaacctgggccacaaacattcaggtggctataaatcaggtaaggcgacttatcggaaacggtaattatctggattacatgacgtcgatgaaaagatttaagaacgagtccgaccccgagggcgccctatggtga

SEQ ID NO: 13230 - RNA, 9879 nt, synthetic construct
  misc_feature 1..9879: note = derived and/or modified CDS sequence (opt3) from DENV-1__FJ850075__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagttggtgtgaacatgtgcacactcattgcaatggacctgggcgagctttgtgaagatactatgacctacaaatgcccacggataacagaggccgaaccggacgatgtagactgttggtgcaatgcgaccgatacttgggtgacatatgggacctgtagtcaaacgggagagcaccgccgagacaagcgtagcgtcgctctggccccccatgtgggcttgggtctcgagactagaaccgaaacatggatgtcctctgagggggcatggaaacagatccagaaggttgaaacttgggccctgaggcaccctggattcaccgtgattgctctgtttctcgcacatgccatcggcacatcgattacccagaagggcatcatattcatcttactgatgcttgtcacgccatcaatggctatgcggtgcgtggggattggaaaccgcgattttgtagagggtttgagcggcgccacttgggttgacgtggtcctggagcacgggagttgtgtgacaaccatggcgaaaaataagcccactctagatatcgaactcctgaaaacagaggtgaccaaccctgcagtccttagaaagctgtgcattgaagccaaaatctccaatacgaccacagactctaggtgtccaactcaaggagaggctaccttggttgaagagcaggatgccaacttcgtgtgccggcgcacatttgtagaccgaggctggggtaatgggtgtggactcttcggcaagggcagcctgttaacttgcgcaaagtttaaatgcgtgaccaagctggaggggaaaatagtccagtacgaaaacctcaagtattccgtgattgttacagtgcacaccggagatcagcatcaagtcggtaatgagactacggaacacggcacaatcgctaccattactccccaggcccctacctcagagatccagcttacagactacggggcgctgaccttggactgtagtccaagaactggactagatttcaacgaaatggtgctgctcacaatgaaagagaagagctggctggtacataaacagtggtttcttgacctgccgttgccctggacgtctggcgcctccacctcacaagagacttggaataggcaggatctcctggttacattcaagaccgcacacgctaagaaacaggaagtggtcgtgttaggtagccaagagggggccatgcacacagctctgactggcgccaccgaaatccagacgagtggaaccacaactatttttgcaggccatctaaagtgccggctcaaaatggacaagctgacccttaaagggatgtcttatgtcatgtgtacaggatccttcaagttggagaaggaagtggccgagactcagcacggtaccgttctggtgcaggtaaaatacgagggcacggatgctccttgcaagataccattcctcacacaagacgaaaaaggggtcacccagaacggacgtctgatcactgcgaatcccattgtgacagataaggagaaacctgttaacatcgaaaccgagccaccctttggcgagagctatatagtggtcggtgcaggggaaaaggcccttaagctgtcgtggttcaaaaagggctcttccattggaaaaatgtttgaggctactgcccgcggcgcaagaaggatggccatcttgggggacaccgcttgggatttcggatcaatcggtggcctctttacaagtgtggggaagctgattcatcaggtattcggaacggcctacggcgtgttatttagcggtgtttcctggaccatgaaaatcgggattggcatactgctaacttggctcggactgaattctcggagcacatcacttagtatgacctgtatcgcagtcggcatggtgacattgtacctgggggtgatggtccaggcggactccggatgcgttattaactggaagggccgagaactcaagtgtggtagcgggatcttcgtgactaacgaggtgcacacctggacggaacaatataaatttcaggctgattctccgaagcgcctgtcagccgcaatcggaaaagcctgggaggagggcgtatgcggtattagaagtgctacaaggttagaaaatataatgtggaagcagatcagcaacgagctgaattacattcttttggaaaacgacatgaaattcaccgtcgtggttggcgacgccaatgggatcctcgcacagggaaagaaaatgattcggcctcaacccatggagcataagtattcctggaagtcttggggcaaagctaagatcataggggccgatatccagaacactacctttattatcgacggaccagatacacctgaatgtcccgacgatcagcgcgcgtggaatatttgggaggtggaggactacggcttcggtatctttactaccaacatatggctgaaactaagagattcgcacacacagatgtgcgaccacaggctgatgagcgccgctattaaggattccaaagcagtccatgccgacatggggtattggatcgaatcagagaagaatgaaacgtggaagctcgctcgtgccagtttcattgaggtgaaaacctgtatctggccaaagtctcacactctgtggagcaacggagttcttgaatccgagatgataatccccaaaatttacggcggtcctatctcacaacataattatcggccaggctacttcacacagaccgcagggccgtggcacttgggaaagctggagttagattttgacctctgcgaaggcactacagtggtagtcgatgagcactgcgggtaccgaggacccagcctgagaaccacgactgtgaccggcaaaacaattcatgaatggtgttgcaggtcttgtacccttcctccactgcgcttccggggtgaggacgggtgctggtatggaatggagatcagacccgtgaaggaaaaggaggaaaacttggtcaggtccatggttagtgcgggcagcggtgaggtggactctttttccctcggcatactgtgtgtatcaattctaatcgaagaggtgatgcgcagtcgatggagccggaaaatgctgatgactgggacactcgccgtcttcctgcttttgatcatgggacagctgacctggaatgatttaattcgtctctgcatcatggtgggcgctaacgcctcggacagaatggggatgggaacaacttacctggcacttatggctacctttaagatgaggcctatgttcgccgttggcctgctatttcgccggctcacgtccagagaggtgctgttgctgacaattggtttatctctcgtcgcaagcgtggaactgccaaattcacttgaggaactgggggatggattggccatgggcataatgatgctcaaactgctaaccgacttccaaccccaccagctgtggactacccttctcagtctgacatttatcaggacttccttgtctctggattatgcttggaagaccatggcgatggccttaagcattgtttccctcttcccgctgtgtctttcaacgacaagccagaaaaccacttggctgcctgtgttgctcggcagttttgggtgcaagccactgacaatgttcctaatcaccgagaacaagatttggggacgaaaatcttggcccatcaacgaaggtataatggcagtcggcatcgtatccattctgcttagctcgctcctgaagaatgacgtgcctttggctgggcccttaatcgccggaggcatgctgattgcctgttacgttatctcaggttctagtgctgatctctccctggagaaagcagccgaggtgagctgggaagaggaagcggagcattctgggactagccacaacatacttgtcgaagtgcaggacgatggaacaatgaagattaaagacgaggagcgcgatgacaccctgacgatcttgctaaaggctactctgctcgccgtatccggcgtgtatccaatgtcaatccctgcaaccctgtttgtctggtacttctggcaaaaaaagaagcagcggagtggcgttctttgggatacacccagcccaccggaagtggagagagccgtgttagacgacgggatttataggatactgcagcgtggactcttgggtcgctctcaggtcggcgtgggggttttccaagatggagtatttcataccatgtggcacgtgacacggggcgctgtcctgatgtaccagggtaaaagactcgaaccttcctgggcatcagtgaagaaagacctgatcagttacgggggaggctggaggttccagggcagctggaatactggggaggaggttcaggtgattgccgtcgaacccggaaagaacccaaaaaatgtgcaaaccacgcccggtacatttaagactcctgagggcgaagtaggggcgatcgctcttgatttcaagccaggaacctccggctctcccattgtcaaccgagagggtaaaatcgtggggctgtatggaaatggcgttgtgacaacctcgggcacttacgtcagcgccatagcacaggccaaggcttcacaggaagggcctttgccggagatcgaggacgaagtgtttaaaaagcggaacctaaccattatggatctgcacccaggatccggtaaaacacgcagatatctccccgccatcgttagggaggcaattaagcggaagttacgaacgctgatccttgctcctactagagtggtcgccagtgaaatggcggaggccctgaaaggcatgccaatacgctaccaaaccacagcagtgaagtctgaacataccgggagggagattgtagacctcatgtgccacgctactttcacaatgcgtttgctgagccccgtgcgggttcctaattataacatgatcatcatggatgaggcccattttaccgacccggcttccattgcagccagaggatacatctcaacgagggtcggcatgggtgaagccgctgcgatattcatgactgcaacacccccagggtctgtggaggcctttcctcagagcaatgctgtgattcaggatgaagagcgcgacatccccgaacgaagttggaactccggatatgattggattaccgacttcccaggcaaaaccgtctggtttgtacctagcatcaagtctggcaatgacatagccaactgtctcagaaaaaatgggaagcgggtgattcagctgtcaaggaagactttcgatacagagtaccaaaaaaccaagaacaacgactgggattacgttgtgacaactgacatctccgagatgggagcaaatttccgcgccgatcgtgtcatcgaccccagacggtgccttaaaccagtgattctaaaggatggtccggaaagggttatcctggctggccctatgcccgtgacggtcgcgagtgccgcacagcgccgagggagaattggacggaaccagaataaagagggcgaccagtatatatacatgggtcaaccattgaacaatgatgaagaccacgctcattggaccgaggccaagatgttactggataacatcaatacacccgaggggattatccctgcactctttgaaccagagagggaaaagagcgccgctatcgacggcgagtatcgcctgagaggagaagccaggaaaactttcgtggagcttatgcggcgtggcgatctgcccgtatggctctcgtacaaggtggcgtctgaggggtttcagtattccgaccgccgatggtgcttcgacggagaaagaaacaatcaggttttggaggaaaacatggatgtcgagatttggaccaaagaaggtgagaggaagaaactgcggcctcgctggctagacgcaagaacatacagcgatccgctggccctcagggagtttaaggaattcgctgccggccggcgatcagtgagtggggaccttatactggagatcggaaaattaccacagcacttgaccctgagagctcaaaatgcactcgataacctggtgatgcttcacaattctgaacagggcggtaaggcctatcgccatgctatggaggaactgcccgacactattgagacgctcatgttgctggccttaatcgcagtcctaaccgggggcgttacactgtttttcctctccggaaagggccttgggaaaactagcattggactgttgtgtgtgatggcgtcaagtgccctgctctggatggctagcgtagagcctcactggatcgccgcatccataatcctggaatttttccttatggtgctcctgattcccgagccagataggcagcggacccctcaggacaaccaattggcttacgtcgtgatcggtctgttatttatgattctaacagttgccgcaaatgaaatgggcctgctcgagaccactaagaaagatcttgggatcggacatgtggccgctgagaaccaccaccatgcgacaatgctggacgtcgatttgcgtcccgcctctgcatggacgctgtacgctgtagccaccactgtgataacaccaatgatgagacacaccattgaaaacaccacagccaatatcagcctcactgcaattgctaaccaggccgcgatcctgatgggccttgacaagggttggcctatatccaaaatggatatcggggttccgttactggctctcggctgctattcacaggtgaatcccttgacgctgaccgccgcagtcctaatgctggtggcccattacgctattatcggaccaggcctccaagcaaaggccacaagggaggcgcagaagcgcactgctgccgggattatgaaaaaccctaccgtcgacggaatcgtgacaatagaccttgatcccgttgtgtatgacgcaaagttcgaaaaacagctgggccagattatgttgctgatcctctgtacctctcaaatcctgttaatgcggactacgtgggccctttgcgagagtattacactggctaccggtccactcactaccctatgggaagggtcgcctggaaagttttggaatacaactatcgccgtaagcatggcaaacatattccgaggctcctacctggctggtgccggcttggcgttctctctgatgaaatcactcgggggaggcagaagggggaccggagcccagggcgagacacttggtgagaagtggaagcgccagctgaatcagttgagcaaatccgaatttaacacgtataagaaaagtgggattatggaggtggatcggtctgaagcaaaggagggactgaaaagaggcgaaaccactaagcacgctgtcagccgtggtacagccaagctcaggtggttcgttgagcggaatttagtgaaacccgagggcaaggtcatcgacctggggtgtggacgcggcgggtggtcatactattgcgcaggacttaaaaaggtgaccgaagtaaaaggctacactaagggtgggccgggacatgaggaaccaattcctatggctacatacggctggaacctggtgaaactacactccggcaaggatgtttttttcacccccccagagaagtgtgacacgctcctgtgcgatatcggggaaagtagccccaatcctaccatagaggagggacgaacattgagagtgctgaaaatggtcgaaccgtggctcaggggtaaccaattttgtatcaagattcttaatccctatatgccatctgtggtcgagactctggaacagatgcagcggaaacacggcgggatgttagtgcgcaaccctctgtccagaaattcaacccatgagatgtactgggttagctgcggaacaggcaacatcgtatcggccgtgaatatgacttctaggatgttgctcaaccgattcaccatggcccaccggaagcccacatatgagcgtgacgtcgatctgggtgcggggaccagacatgtggctgttgaacctgaggtggcaaacctagacattatcggacagcgcattgaaaatatcaaaaacgagcacaagagtacttggcactacgatgaagacaatccatataagacgtgggcctaccatggctcctatgaggtcaaacccagcggctcagcttcctctatggtgaacggggtagtgaggcttctgacaaagccttgggacgttataccaatggtcacccaaattgccatgactgataccacaccctttggacagcagcgggtgttcaaagagaaggtggacacgagaaccccgcgcgcaaaaaggggtactgcccaaatcatggaagtcacagctaagtggctctggggctttctgagccgaaataagaaacctcggatctgtaccagagaggaattcactaggaaggttcgcagtaacgcggccattggggcagtgtttgtagatgagaatcagtggaactccgctaaagaagccgtggaggacgagcgtttctgggatttggtccaccgggaaagagagctgcataagcagggaaaatgcgcaacatgcgtgtacaatatgatgggcaagagggaaaagaaactcggtgagtttgggaaggccaaaggaagccgcgctatatggtacatgtggcttggcgcccgattcctggaattcgaggcgttaggctttatgaacgaggaccactggttctctcgggaaaattcactgagtggggttgagggagaaggtttgcataagctcggctatatcctgagagatatttccaaaatcccagggggaaacatgtacgcagacgataccgccggctgggacacaaggattactgaggatgacctacagaatgaggctaagatcaccgatataatggaacccgagcacgcccttctggcaacgagcatctttaaactcacctatcaaaacaaggtggtccgcgtgcagagacctgctaagtctggtacagtaatggacgttatttcgcggagggaccagcgtgggtcaggacaggtgggcacttacggcctgaataccttcacaaacatggaagtccaattgatccgacagatggagagcgaagggattttttccccaagtgagttagagactcccaacctggccaaacgcgtgctcgattggcttgaaaagcacggagtggagagactgaaacggatggctatctctggtgacgattgtgtcgttaagccgatagacgataggttcgccaccgcactaacggcgctgaatgacatgggcaaagtgcgcaaggatattcctcagtgggaacccagcaaggggtggaacgactggcagcaagtaccattttgctcccatcacttccatcagctcatcatgaaagatggaagagagatcgtggtcccttgtcggaatcaggacgaattggtgggcagggcccgagtttcacagggtgctgggtggagtctgcgtgagacagcctgccttggaaagtcttatgcacaaatgtggcagctgatgtactttcacagacgcgatctccggttagctgccaacgcaatttgtagcgccgtgcccgtcgactgggtgccaacctccaggactacatggtcaatacacgcgcatcaccagtggatgaccactgaggacatgctgagcgtatggaatagagtttggatcgaagagaacccctggatggaagataaaacccatgtgtcttcctgggaggaagtcccttatttgggcaagcgcgaggaccaatggtgcggcagtctgattgggctcacagctcgggccacgtgggcaaccaatatccaggtggccattaaccaggttaggcgacttatcggaaatgagaactacctggattacatgactagcatgaaaagattcaagaatgaatcggacccagagggtgctctatggtga

SEQ ID NO: 13231 - RNA, 9879 nt, synthetic construct
  misc_feature 1..9879: note = derived and/or modified CDS sequence (opt3) from DENV-1__FJ850077__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagttggtgtgaacatgtgcacactcattgcaatggacctgggcgagctttgtgaagatactatgacctacaaatgcccacggataacagaggtagaaccggacgatgtggactgttggtgcaatgccaccgatacttgggtcacatatgggacctgtagtcaaacgggagagcaccgccgagacaagcgtagcgtggcgctggctccccatgttggcttgggtctcgagactagaaccgaaacatggatgtcctctgagggggcctggaaacaggtgcagaaggtcgaaacttgggcactgaggcaccctggattcaccgtgatcgccctgtttctcgctcatgcaattggcacatcgatcacccagaagggcattatcttcatattactgatgcttgtaacgccatcaatggccatgcggtgcgttgggatcggaaaccgcgattttgtggagggtttgagcggcgctacttgggtcgacgtggtgctggagcacgggagttgtgtcacaaccatggccaaaaataagcccactctagatattgaactcctgaaaacagaggttaccaaccctgcggtgcttagaaagctgtgcatcgaagcaaaaatttccaatacgaccacagactctaggtgtccaactcaaggagaggccaccttggtagaagagcaggatgctaacttcgtgtgccggcgcacatttgtcgaccgaggctggggtaatgggtgtggactcttcggcaagggcagcctgttaacttgcgccaagtttaaatgcgtgaccaagctggaggggaaaatcgttcagtacgaaaacctcaagtattccgtgatagtcacagtgcacaccggagatcagcatcaagtaggtaatgagactacggaacacggcacaattgcaaccatcactccccaggctcctacctcagagattcagcttacagactacggggccctgaccttggactgtagtccaagaactggactagatttcaacgaaatggttctgctcacaatgaaagagaagagctggctggtgcataaacagtggtttcttgacctgccgttgccctggacgtctggcgcgtccacctcacaagagacttggaataggcaggatctcctggtcacattcaagaccgcccacgcaaagaaacaggaagtggtcgtgttaggtagccaagagggggctatgcacacagccctgactggcgctaccgaaatccagacgagtggaaccacaactatctttgccggccatctaaagtgccggctcaaaatggacaagctgacccttaaagggatgtcttatgttatgtgtacaggatccttcaagttggagaaggaagtggcagagactcagcacggtaccgtactggtccaggtgaaatacgagggcacggatgccccttgcaagattccattcctcacacaagacgaaaaaggggttacccagaacggacgtctgataactgctaatcccatcgtgacagataaggagaaacctgtcaacattgaaaccgagccaccctttggcgagagctatatcgtggtaggtgcgggggaaaaggcacttaagctgtcgtggttcaaaaagggctcttccataggaaaaatgtttgaggccactgctcgcggcgccagaaggatggcaattttgggggacaccgcctgggatttcggatcaatcggtggcctctttacaagtgtggggaagctgatccatcaggttttcggaacggcttacggcgtcttatttagcggtgtgtcctggaccatgaaaattgggatcggcattctgctaacttggctcggactgaattctcggagcacatcacttagtatgacctgtatagccgtgggcatggtcacattgtacctgggggttatggtgcaggcagactccggatgcgtgatcaactggaagggccgagaactcaagtgtggtagcgggattttcgtaactaacgaggtccacacctggacggaacaatataaatttcaggcggattctccgaagcgcctgtcagctgccatcggaaaagcatgggaggagggcgtgtgcggtatcagaagtgccacaaggttagaaaatattatgtggaagcagataagcaacgagctgaattacatccttttggaaaacgacatgaaattcaccgttgtggtcggcgacgctaatgggattctcactcagggaaagaaaatgatccggcctcaacccatggagcataagtattcctggaagtcttggggcaaagccaagattatcggggcagatatacagaacaccacatttatcattgacggaccagatactcctgaatgtcccgacgatcagcgcgcttggaatatctgggaggtggaggactacggcttcggtatttttaccacaaacatctggctgaaactaagagattcgtatacgcagatgtgcgaccacaggctgatgagcgccgcgataaaggattccaaagccgttcacgctgacatggggtactggattgaatcagagaagaatgaaacctggaagctcgcacgtgccagtttcatcgaggtgaaaacttgtatttggccaaagtctcatacactgtggagcaacggagtacttgaatccgagatgatcatacccaaaatctatggcggtcctacctcacaacacaattaccggccaggctacttcactcagacagctgggccgtggcatttgggaaagctggagttagattttgacctctgcgaaggcaccacggtcgtggtggatgagcactgcgggtatcgaggacccagcctgagaactaccacagtcaccggcaaaattatccacgaatggtgttgcaggtcttgtactcttcctccactgcgcttccggggtgaggacgggtgctggtacggaatggagattagacccgttaaggaaaaggaggaaaacttggtgaggtccatggtaagtgccggcagcggtgaggtggactctttttccctcggcatcctgtgtgtctcaatactaattgaagaggtgatgcgcagtcgatggagccggaaaatgctgatgacagggaccctcgcagttttcctgcttttgatcatgggacagctgacatggaatgatttaatccgtctctgcattatggtgggcgcgaacgcctcggacagaatggggatgggaactacctatctggctcttatggccacgtttaagatgaggcctatgttcgcagtcggcctgctatttcgcaaactcacatcccgggaggtgctgttgctgaccatcggtttatctctcgttgctagcgtggaactgccaaattcacttgaggaactgggggatggattggccatgggcattatgatgctcaagctgctaactgacttccaaccccatcagctgtggaccacacttctcagtctgacttttataagaacctccttgtctctggattacgcatggaaaacgatggccatggctttaagcatcgtctccctcttcccgctgtgtctttcaacaaccagccagaagactacatggctgcctgtattgctcggcagttttgggtgcaagccactgaccatgttcctaattactgagaacaggatctggggacgaaaatcttggcccattaacgaaggtgtgatggcggttggcatcgtgtccatactgcttagctcgctcctgaagaatgacgtccctttggccgggcccttaatcgcaggaggcatgctgattgcttgttatgtgatctcaggttctagtgccgatctctccctggagaaagccgctgaggtaagctgggaagaggaagcagagcactctgggacaagccataacattcttgtggaagtccaggacgatggaaccatgaagatcaaagacgaggagcgcgatgacacgctgactatattgctaaaggccaccctgctcgcggtttccggcgtgtacccaatgtcaattcctgctacactgtttgtgtggtatttctggcaaaaaaagaagcagcggagtggcgtcctttgggatacccccagcccaccggaagtggagagagccgttttagacgacgggatctacaggatcctgcagcgtggactcttgggtcgctctcaggtaggcgtgggggtcttccaagatggagtgtttcacacaatgtggcatgttactcggggcgcagtgctgatgtaccagggtaaaagactcgaaccttcctgggcctcagtcaagaaagacctgattagttatgggggaggctggaggttccagggcagctggaataccggggaggaggtgcaggtaatagctgtcgaacccggaaagaacccaaaaaatgtgcaaacgacacccggtacttttaagacccctgagggcgaagttggggcaatcgcccttgatttcaagccaggaacatccggctctcccattgtgaaccgagagggtaaaatcgtcgggctgtacggaaatggcgtggttaccacttcgggcacctatgtgagcgcgattgctcaggccaaggcatcacaggaagggcctttgccggagatcgaggacgaagtctttaaaaagcggaacctaacaataatggatctgcacccaggatccggtaaaacgcgcagatacctccccgccatcgtgagggaggctattaagcggaagttacgaactctgatccttgcccctaccagagtagtggcaagtgaaatggctgaggccctgaaaggcatgccaattcgctatcaaacaaccgcggttaagtctgaacacactgggagggagatcgtcgacctcatgtgccatgccacattcaccatgcgtttgctgagccccgtgcgggtgcctaattacaacatgataattatggatgaggcacactttacggacccggcttccatcgccgctagaggatatatctcaactagggtcggcatgggtgaagcagccgccattttcatgacagctacccccccagggtctgtagaggcgtttcctcagagcaatgcagtgatccaggatgaagagcgcgacatacccgaacgaagttggaactccggatacgattggattaccgacttcccaggcaaaactgtttggtttgtgcctagcatcaagtctggcaatgacattgccaactgtctcagaaaaaatgggaagcgggtcatccagctgtcaaggaagacattcgataccgagtaccaaaaaacaaagaacaacgactgggattatgtggttactacggacatatccgagatgggagctaatttccgcgccgatcgtgtgattgaccccagacggtgccttaaaccagtcatcctaaaggatggtccggaaagggtgatcctggcaggccctatgcccgtaaccgtggccagtgctgcgcagcgccgagggagaattggacggaaccagaataaagagggcgaccagtacatctatatgggtcaaccattgaacaatgatgaagaccatgcccactggacagaggcaaagatgttactggataacattaatactcccgaggggataatccctgctctctttgaaccagagagggaaaagagcgccgcaattgacggcgagtaccgcctgagaggagaagccaggaaaaccttcgttgagcttatgcggcgtggcgatctgcccgtctggctctcgtataaggtggcttctgaggggtttcagtactccgaccgccgatggtgcttcgacggagaaagaaacaatcaggtgttggaggaaaacatggatgtcgagatctggacaaaagaaggtgagaggaagaaactgcggcctcgctggctagacgccagaacctatagcgatccgctggcgctcagggagtttaaggaattcgcagccggccggcgatcagttagtggggaccttatcctggagattggaaaattaccacagcatttgactctgagagctcaaaatgccctcgataacctggtgatgcttcacaattctgaacagggcggtaaggcttaccgccacgcaatggaggaactgcccgacacgatagagaccctcatgttgctggccttaatcgctgtactaacagggggcgtgactctgtttttcctctccggaaagggccttgggaaaaccagcattggactgttgtgtgtcatggcctcaagtgcactgctctggatggcgagcgtggagcctcattggatcgccgcttccattatcctggaatttttccttatggttctcctgatacccgagccagataggcagcggacacctcaggacaaccaattggcctacgtggtcatcggtctgttatttatgattctaaccgtagcagctaatgaaatgggcctgctcgagactacaaagaaagatcttgggatcggacacgtggccgcagagaaccatcaccacgccacgatgctggacgttgatttgcgtcccgcttctgcgtggaccctgtatgccgtggcaactacagtcattaccccaatgatgagacataccatcgaaaacacaactgctaatataagcctcacggccattgccaaccaggcagctatcctgatgggccttgacaagggttggcctatttccaaaatggatatcggggtgccgttactggccctcggctgctactcacaggtcaatcccttgaccctgacagcgactgtgctaatgctggttgctcactatgccataatcggaccaggcctccaagcaaaggccaccagggaggctcagaagcgcacagcagccgggattatgaaaaaccctaccgtggacggaatcgtaactattgaccttgatcccgtggtctacgacgcgaagttcgaaaaacagctgggccagatcatgttgctgatactctgtacgtctcaaattctgttaatgcggacaacctgggctctttgcgagagtatcactctggccaccggtccactcacaactctatgggaagggtcgcctggaaagttttggaataccacaatcgcagttagcatggccaacattttccgaggctcctatctggctggtgccggcttggcattctctctgatgaaatcactcgggggaggcagaagggggacgggagctcagggcgagacccttggtgagaagtggaagcgccagctgaatcagttgagcaaatccgaatttaacacttacaagaaaagtgggatcatggaggtggatcggtctgaagccaaggagggactgaaaagaggcgaaacaaccaagcatgcggtcagccgtggtactgccaagctcaggtggttcgtggagcggaatttagtaaaacccgagggcaaggtgatagacctggggtgtggacgcggcgggtggtcatattactgcgcaggacttaaaaaggttacagaagtgaaaggctacaccaagggtgggccgggacacgaggaaccaattcctatggctacgtatggctggaacctggtcaaactacattccggcaaggatgtgtttttcacccccccagagaagtgtgacacactcctgtgcgatatcggggaaagtagccccaatcctactattgaggagggacgaaccttgagagtcctgaaaatggtggaaccgtggctcaggggtaaccaattttgtatcaagatacttaatccctacatgccatctgttgtagagacactggaacagatgcagcggaaacacggcgggatgttagtgcgcaaccctctgtccagaaattcaactcacgagatgtattgggtcagctgcggaaccggcaacatcgtgtcggccgttaatatgacatctaggatgttgctcaaccgattcaccatggcacatcggaagcccacttacgagcgtgacgtggatctgggtgctgggacgagacacgtcgccgtggaacctgaggtagccaacctagacattatcggacagcgcattgaaaatatcaaaaacgagcataagagtacatggcactatgatgaagacaatccatacaagacctgggcgtatcacggctcctacgaggtgaaacccagcggctcagcttcctctatggttaacggggtcgtgaggcttctgactaagccttgggacgtgattccaatggtcacccaaatcgcaatgacagatacgaccccctttggacagcagcgggttttcaaagagaaggtggacactagaacaccgcgcgccaaaaggggtaccgctcaaataatggaagtaactgccaagtggctctggggctttctgagccgaaataagaaacctcggatttgtacaagagaggaattcaccaggaaggtgcgcagtaacgcagccatcggggctgtctttgtggatgagaatcagtggaactccgcgaaagaagccgttgaggacgagcgtttctgggatttggtgcatcgggaaagagagctgcacaagcagggaaaatgcgcaacatgcgtctacaatatgatgggcaagagggaaaagaaactcggtgagtttgggaaggctaaaggaagccgcgccatctggtatatgtggcttggcgcacgattcctggaattcgaggccttaggctttatgaacgaggaccattggttctctcgggaaaattcactgagtggggtggagggagaaggtttgcacaagctcggctacattctgagagatatatccaaaatcccagggggaaacatgtatgctgacgatactgccggctgggacaccaggattacggaggatgacctacagaatgaggcgaagatcaccgatattatggaacccgagcatgcacttctggccacaagcatctttaaactcacttaccaaaacaaggtagttcgcgtgcagagacctgctaagtctggtaccgtcatggacgtgatatcgcggagggaccagcgtgggtcaggacaggtgggcacatatggcctgaatactttcaccaacatggaagtccaattgatccgacagatggagagcgaagggattttttccccaagtgagttagagacgcccaacctggccaaacgcgttctcgattggcttgaaaagcacggagcagagagactgaaacggatggctatctctggtgacgattgtgtggtaaagccgattgacgataggttcgccacagctctaaccgccctgaatgacatgggcaaagtgcgcaaggatatccctcagtgggaacccagcaaggggtggaacgactggcagcaagtcccattttgctcccaccatttccaccagctcataatgaaagatggaagagacattgtggttccttgtcggaatcaggatgagttggtgggcagggcacgagtctcacagggtgcggggtggagtctgcgtgaaactgcctgccttggaaagtcttacgctcaaatgtggcagctgatgtattttcatagacgcgacctccggttagccgcaaacgctatctgtagcgccgtgcccgtagactgggttccaacatccaggaccacttggtcaatccacgcacaccatcagtggatgaccacagaggatatgctgagcgtgtggaatagagtctggattgaggaaaacccctggatggaggacaaaacgcacgtgtcttcctgggaagaggttccttacttgggcaagcgcgaagatcaatggtgcggcagtctgatagggctcaccgcccgggcgacttgggctacaaatatccaggtggccattaaccaggtcaggcgacttatcggaaatgagaactacctggactatatgaccagcatgaaaagattcaagaatgagtcggatccagaaggtgcactatggtga

SEQ ID NO: 13232 - RNA, 9879 nt, synthetic construct
  misc_feature 1..9879: note = derived and/or modified CDS sequence (opt3) from DENV-1__FJ850081__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagttggtgtgaacatgtgcacactcattgcaatggacctgggcgagctttgtgaagatactatgacctacaaatgcccacggataacagaggccgaaccggacgatgtagactgttggtgcaatgcgaccgatacttgggtgacatatgggacctgtagtcaaacgggagagcaccgccgagacaagcgtagcgtcgctctggccccccatgtgggcttgggtctcgagactagaaccgaaacatggatgtcctctgagggggcatggaaacagatccagaaggttgaaacttgggccctgaggcaccctggattcaccgtgattgctctgtttctcgcacatgccatcggcacatcgattacccagaagggcatcatattcatcttactgatgcttgtcacgccatcaatggctatgcggtgcgtggggattggaaaccgcgattttgtagagggtttgagcggcgccacttgggttgacgtggtcctggagcacgggagttgtgtgacaaccatggcgaaaaataagcccactctagatatcgaactcctgaaaacagaggtgaccaaccctgcagtccttagaaagctgtgcattgaagccaaaatctccaatacgaccacagactctaggtgtccaactcaaggagaggctaccttggttgaagagcaggatgccaacttcgtgtgccggcgcacatttgtagaccgaggctggggtaatgggtgtggactcttcggcaagggcagcctgttaacttgcgcaaagtttaaatgcgtgaccaagctggaggggaaaatagtccagtacgaaaacctcaagtattccgtgattgttacagtgcacaccggagatcagcatcaagtcggtaatgagactacggaacacggcacaatcgctaccattactccccaggcccctacctcagagatccagcttacagactacggggcgctgaccttggactgtagtccaagaactggactagatttcaacgaaatggtgctgctcacaatgaaagagaagagctggctggtacataaacagtggtttcttgacctgccgttgccctggacgtctggcgcctccacctcacaagagacttggaataggcaggatctcctggttacattcaagaccgcacacgctaagaaacaggaagtggtcgtgttaggtagccaagagggggccatgcacacagctctgactggcgccaccgaaatccagacgagtggaaccacaactatttttgcaggccatctaaagtgccggctcaaaatggacaagctgacccttaaagggatgtcttatgtcatgtgtacaggatccttcaagttggagaaggaagtggccgagactcagcacggtaccgttctggtgcaggtaaaatacgagggcacggatgctccttgcaagataccattcctcacacaagacgaaaaaggggtcacccagaacggacgtctgatcactgcgaatcccattgtgacagataaggagaaacctgttaacatcgaaaccgagccaccctttggcgagagctatatagtggtcggtgcaggggaaaaggcccttaagctgtcgtggttcaaaaagggctcttccattggaaaaatgtttgaggctactgcccgcggcgcaagaaggatggccatcttgggggacaccgcttgggatttcggatcaatcggtggcctctttacaagtgtggggaagctgattcatcaggtattcggaacggcctacggcgtgttatttagcggtgtttcctggaccatgaaaatcgggattggcatactgctaacttggctcggactgaattctcggagcacatcacttagtatgacctgtatcgcagtcggcatggtgacattgtacctgggggtgatggtccaggcggactccggatgcgttattaactggaagggccgagaactcaagtgtggtagcgggatcttcgtgactaacgaggtgcacacctggacggaacaatataaatttcaggctgattctccgaagcgcctgtcagccgcaatcggaaaagcctgggaggagggcgtatgcggtattagaagtgctacaaggttagaaaatataatgtggaagcagatcagcaacgagctgaattacattcttttggaaaacgacatgaaattcaccgtcgtggttggcgacgccaatgggatcctcgcacagggaaagaaaatgattcggcctcaacccatggagcataagtattcctggaagtcttggggcaaagctaagatcataggggccgatatccagaacactacctttattatcgacggaccagatacacctgaatgtcccgacgatcagcgcgcgtggaatatttgggaggtggaggactacggcttcggtatctttactaccaacatatggctgaaactaagagattcgcacacacagatgtgcgaccacaggctgatgagcgccgctattaaggattccaaagcagtccatgccgacatggggtattggatcgaatcagagaagaatgaaacgtggaagctcgctcgtgccagtttcattgaggtgaaaacctgtatctggccaaagtctcacactctgtggagcaacggagttcttgaatccgagatgataatccccaaaatttacggcggtcctatctcacaacataattatcggccaggctacttcacacagaccgcagggccgtggcacttgggaaagctggagttagattttgacctctgcgaaggcactacagtggtagtcgatgagcactgcgggtaccgaggacccagcctgagaaccacgactgtgaccggcaaaattatccatgaatggtgttgcaggtcttgtacacttcctccactgcgcttccggggtgaggacgggtgctggtatggaatggagataagacccgtgaaggaaaaggaggaaaacttggtcaggtccatggttagtgcgggcagcggtgaggtggactctttttccctcggcattctgtgtgtatcaatcctaatcgaagaggtgatgcgcagtcgatggagccggaaaatgctgatgaccgggactctcgccgtcttcctgcttttgattatgggacagctgacatggaatgatttaatccgtctctgcattatggtgggcgctaacgcctcggacagaatggggatgggaaccacatacctggcacttatggctacttttaagatgaggcctatgttcgccgttggcctgctatttcgccggctcacctccagagaggtgctgttgctgacgataggtttatctctcgtcgcaagcgtggaactgccaaattcacttgaggaactgggggatggattggccatgggcatcatgatgctcaaactgctaacagacttccaaccccaccagctgtggaccactcttctcagtctgacctttattaggacatccttgtctctggattatgcttggaagactatggcgatggccttaagcatcgtttccctcttcccgctgtgtctttcaaccacgagccagaaaacaacctggctgcctgtgttgctcggcagttttgggtgcaagccactgactatgttcctaattacagagaacaagatctggggacgaaaatcttggcccataaacgaaggtatcatggcagtcggcattgtatccatcctgcttagctcgctcctgaagaatgacgtgcctttggctgggcccttaattgccggaggcatgctgatcgcctgttacgttatatcaggttctagtgctgatctctccctggagaaagcagccgaggtgagctgggaagaggaagcggagcattctgggaccagccacaacattcttgtcgaagtgcaggacgatggaactatgaagatcaaagacgaggagcgcgatgacacactgaccatcttgctaaaggctacgctgctcgccgtatccggcgtgtatccaatgtcaattcctgcaactctgtttgtctggtacttctggcaaaaaaagaagcagcggagtggcgttctttgggatacccccagcccaccggaagtggagagagccgtgttagacgacgggatatataggatcctgcagcgtggactcttgggtcgctctcaggtcggcgtgggggttttccaagatggagtatttcatacaatgtggcacgtgacccggggcgctgtcctgatgtaccagggtaaaagactcgaaccttcctgggcatcagtgaagaaagacctgattagttacgggggaggctggaggttccagggcagctggaatacaggggaggaggttcaggtgatcgccgtcgaacccggaaagaacccaaaaaatgtgcaaactacccccggtacgtttaagacacctgagggcgaagtaggggcgattgctcttgatttcaagccaggaacttccggctctcccatcgtcaaccgagagggtaaaatagtggggctgtatggaaatggcgttgtgaccacatcgggcacctacgtcagcgccatcgcacaggccaaggcttcacaggaagggcctttgccggagattgaggacgaagtgtttaaaaagcggaacctaactatcatggatctgcacccaggatccggtaaaacccgcagatatctccccgccattgttagggaggcaatcaagcggaagttacgaacactgatacttgctcctacgagagtggtcgccagtgaaatggcggaggccctgaaaggcatgccaattcgctaccaaactaccgcagtgaagtctgaacatacagggagggagatcgtagacctcatgtgccacgctaccttcactatgcgtttgctgagccccgtgcgggttcctaattataacatgatcattatggatgaggcccattttacagacccggcttccatcgcagccagaggatacatatcaaccagggtcggcatgggtgaagccgctgcgattttcatgacggcaactcccccagggtctgccgaggcttttcctcagagcaatgccgtgatccaggatgaagagcgcgacattcccgaacgaagttggaactccggatatgattggatcacagacttcccaggcaaaaccgtgtggtttgtccctagcataaagtctggcaatgacattgcaaactgtctcagaaaaaatgggaagcgggtaatccagctgtcaaggaagaccttcgatactgagtaccaaaaaacaaagaacaacgactgggattacgtggttaccacagacatctccgagatgggagccaatttccgcgctgatcgtgtgattgaccccagacggtgccttaaaccagtcatcctaaaggatggtccggaaagggtgattctggcgggccctatgcccgttactgtggccagtgcagctcagcgccgagggagaataggacggaaccagaataaagagggcgaccagtatatctacatgggtcaaccattgaacaatgatgaagaccacgcccattggacggaggcaaagatgttactggataacattaatacccccgaggggatcatccctgccctctttgaaccagagagggaaaagagcgctgccattgacggcgagtatcgcctgagaggagaagcgaggaaaacattcgtcgagcttatgcggcgtggcgatctgcccgtgtggctctcgtacaaggtagcatctgaggggtttcagtattccgaccgccgatggtgcttcgacggagaaagaaacaatcaggtgttggaggaaaacatggatgttgagatatggactaaagaaggtgagaggaagaaactgcggcctcgctggctagacgccagaacctacagcgatccgctggctctcagggagtttaaggaattcgccgctggccggcgatcagtcagtggggaccttatcctggagattggaaaattaccacagcacttgacactgagagcacaaaatgccctcgataacctggtgatgcttcacaattctgaacagggcggtaaggcttatcgccatgccatggaggaactgcccgacaccatcgagactctcatgttgctggcattaattgcggtgctaacggggggcgtcaccctgtttttcctctccggaaagggccttgggaaaacaagcatcggactgttgtgtgttatggcctcaagtgctctgctctggatggccagcgtggagcctcactggatagcagcttccatcattctggaatttttccttatggtactcctgatccccgagccagataggcagcggactcctcaggacaaccaattggcctacgtggtcattggtctgttatttatgatcctaaccgtggcagccaatgaaatgggcctgctcgagacaaccaagaaagatcttgggataggacatgttgctgcggagaaccaccaccatgccactatgctggacgtggatttgcgtcccgcatctgcttggacactgtacgccgtcgccacgaccgtaattactccaatgatgagacacacaatcgaaaacaccaccgcaaatattagcctcacagctatcgccaaccaggcggctatactgatgggccttgacaagggttggcctatctccaaaatggatattggggtgccgttactggccctcggctgctattcacaggttaatcccttgactctgacggcagccgtgctaatgctggtcgctcattacgcaatcattggaccaggcctccaagccaaggcgaccagggaggctcagaagcgcacagccgcagggatcatgaaaaaccctactgtggacggaatagtcaccattgaccttgatcccgtggtttatgacgccaagttcgaaaaacagctgggccagatcatgttgctgatcctctgtacatctcaaattctgttaatgcggaccacttgggctctttgcgagagtatcacgctggccacaggtccactcaccactctatgggaagggtcgcctggaaagttttggaataccacaatagcagtgagcatggctaacattttccgaggctcctacctggccggtgcgggcttggccttctctctgatgaaatcactcgggggaggcagaagggggactggagcacagggcgagacccttggtgagaagtggaagcgccagctgaatcagttgagcaaatccgaatttaacacatataagaaaagtgggatcatggaggtagatcggtctgaagctaaggagggactgaaaagaggcgaaacgaccaagcacgccgtgagccgtggtactgcaaagctcaggtggttcgtcgagcggaatttagttaaacccgagggcaaggtgattgacctggggtgtggacgcggcgggtggtcatactattgcgctggacttaaaaaggtcacagaagtgaaaggctacaccaagggtgggccgggacatgaggaaccaatccctatggccacttacggctggaacctggtaaaactacactccggcaaggatgtgtttttcacacccccagagaagtgtgacaccctcctgtgcgatataggggaaagtagccccaatcctacgatcgaggagggacgaaccttgagagttctgaaaatggtggaaccgtggctcaggggtaaccaattttgtattaagatccttaatccctatatgccatctgtcgtggagacactggaacagatgcagcggaaacacggcgggatgttagtccgcaaccctctgtccagaaattcaactcatgagatgtactgggtgagctgcggaaccggcaacattgtttcggccgtaaatatgacatctaggatgttgctcaaccgattcactatggcgcaccggaagcccacctatgagcgtgacgtggatctgggtgctgggacaagacatgtcgcagtggaacctgaggttgccaacctagacatcattggacagcgcatcgaaaatataaaaaacgagcacaagagtacctggcactacgatgaagacaatccatataagacttgggcttaccatggctcctatgaggtgaaacccagcggctcagcctcctctatggtcaacggggtggtaaggcttctgacgaagccttgggacgtgattccaatggttacacaaatcgcaatgaccgatactaccccctttggacagcagcgggtcttcaaagagaaggtggacacaagaacgccgcgcgccaaaaggggtaccgctcaaatcatggaagtgactgcgaagtggctctggggctttctgagccgaaataagaaacctcggatttgtacaagagaggaattcaccaggaaggtccgcagtaacgccgcaataggggctgtttttgtggatgagaatcagtggaactccgccaaagaagcagtagaggacgagcgtttctgggatttggtgcaccgggaaagagagctgcataagcagggaaaatgcgccacttgcgtctacaatatgatgggcaagagggaaaagaaactcggtgagtttgggaaggctaaaggaagccgcgccatctggtacatgtggcttggcgcgcgattcctggaattcgaggcattaggctttatgaacgaggaccactggttctctcgggaaaattcactgagtggggtggagggagaaggtttgcataagctcggctatattctgagagatatctccaaaattccagggggaaacatgtacgccgacgatacagctggctgggacaccaggatcacagaggatgacctacagaatgaggccaagataactgatatcatggaacccgagcacgcacttctggctaccagcatttttaaactcacgtatcaaaacaaggttgtgcgcgtccagagacctgccaagtctggtaccgtgatggacgtaatctcgcggagggaccagcgtgggtcaggacaggttggcacatacggcctgaatactttcaccaacatggaagtgcaattgattcgacagatggagagcgaagggatcttttccccaagtgagttagagacacccaacctggctaaacgcgtcctcgattggcttgaaaagcacggagccgagagactgaaacggatggcaatatctggtgacgattgtgtggtgaagccgattgacgataggttcgcgactgccctaaccgctctgaatgacatgggcaaagtccgcaaggatatccctcagtgggaacccagcaaggggtggaacgactggcagcaagttccattttgctcccatcacttccatcagctcatcatgaaagatggaagagagattgtggtaccttgtcggaatcaggacgaattggtgggcagggcccgagtctcacagggtgcagggtggagtctgcgtgagacggcttgccttggaaagtcttatgcccaaatgtggcagctgatgtactttcacagacgcgatctccggttagcagccaacgcgatatgtagcgctgtgcccgttgactgggtgccaacatccaggaccacttggtcaatccacgcccatcaccagtggatgacaaccgaggacatgctgagcgtctggaatagagtgtggattgaagagaacccctggatggaagataaaactcatgtatcttcctgggaggaagttccttatttgggcaagcgcgaggaccaatggtgcggcagtctgatcgggctcaccgcacgggccacatgggctacgaatattcaggtggccatcaaccaggtcaggcgacttataggaaatgagaactacctggattacatgaccagcatgaaaagattcaagaatgaatcggacccagagggtgcactatggtga

SEQ ID NO: 13233 - RNA, 9879 nt, synthetic construct
  misc_feature 1..9879: note = derived and/or modified CDS sequence (opt3) from DENV-1__FJ850084__SS-prME
  source 1..9879: mol_type = other RNA
agcgtgaccatgctgctcatgcttctgcccacagccttggctttccacttaactacgagaggcggggaacctcatatgatcgtctccaagcaggaaagaggcaaatctctgctgtttaagacctcagttggtgtgaacatgtgcacactcattgctatggacctgggcgaactttgtgaagatactatgacctacaaatgcccacggattacagaagtagaaccggacgatgtggactgttggtgcaatgccaccgatacttgggtcacatatgggacctgtagtcaaacgggagagcaccgccgagacaagcgtagcgtggcgctggctccccatgttggcttgggtctcgagactagaaccgaaacatggatgtcctctgagggggcctggaaacagatccagaaggtggaaacttgggccctgaggcaccctggattcaccgtcattgccctgtttctcgctcatgcaatcggcacatcgattacccagaagggcatcatattcatcttactgatgcttgtgacgccatcaatggccatgcggtgcgtagggattggaaaccgcgattttgttgagggtttgagcggcgctacttgggtggacgtcgtgctggagcacgggagttgtgtgacaaccatggccaaaaataagcccactctagatatcgaactcctgaaaacagaggtcaccaaccctgcggttcttagaaagctgtgcattgaagcaaaaatctccaatacgaccacagactctaggtgtccaactcaaggagaggccaccttggtggaagaacaggatgctaacttcgtatgccggcgcacatttgtggaccgaggctggggtaatgggtgtggactcttcggcaagggcagcctgttaacttgcgccaagtttaaatgcgtcaccaagctggaggggaaaatagtgcagtacgaaaacctcaagtattccgttattgtgacagtccacaccggagatcagcatcaagtgggtaatgagactacggaacacggcacaatcgcaaccattactccccaggctcctacctcagagatccagcttacagactacggggccctgaccttggactgtagtccaagaactggactagatttcaacgaaatggtactgctcacaatgaaagagaaaagctggctggttcataaacagtggtttcttgacctgccgttgccctggacgtctggcgcgtccacctcacaagaaacttggaataggcaggatctcctggtgacattcaagaccgcccacgcaaagaaacaggaagtcgtggtcttaggtagccaagagggggctatgcacacagccctgactggcgctaccgaaatccagacgagtggaaccacaactatttttgccggccatctaaagtgccggctcaaaatggacaagctgacccttaaagggatgtcttatgtgatgtgtacaggatccttcaagttggagaaggaagttgcagagactcagcacggtaccgtgctggtacaggtcaaatacgagggcacggatgccccttgcaagataccattcctcacacaagacgaaaaaggggtgacccagaacggacgtctgatcactgctaatcccattgttacagataaggagaaacctgtgaacatcgaaaccgagccaccctttggcgagagctatatagtcgtgggtgcgggggaaaaggcacttaagctgtcgtggttcaaaaagggatcttccattggaaaaatgtttgaggccactgctcgcggcgccagaaggatggcaatcttgggggacaccgcctgggatttcggatcaatcggtggcctctttacaagtgtagggaagctgattcatcaggtgttcggagctgcctacggcgttttatttagcggtgtctcctggacgatgaaaatcgggattggcatactgctaacctggctcggactaaattctcggagcacttcacttagtatgacatgtatcgcagtgggcatggtgaccttgtacctgggggtcatggttcaggcggactccggatgcgtgattaactggaagggccgagaactcaagtgtggtagcgggatcttcgtgacaaacgaggtacacacttggaccgaacaatataaatttcaggctgattctccgaagcgcctgtcagccgcaatcggaaaagcctgggaggagggcgtctgcggtattagaagtgctacgaggttagaaaatataatgtggaagcagatcagcaacgagctgaattacattcttttggaaaacgacatgaaattcacagtggttgtgggcgacgccaatgggatcctcacccagggaaagaaaatgattcggcctcaacccatggagcataagtattcctggaagtcttggggcaaagcaaagatcataggggctgatatccagaacactacctttattatcgacggaccagatacacctgaatgtcccgacgatcagcgcgcctggaatatttgggaggtcgaggactacggcttcggtatctttactaccaacatatggctgaaactaagagattcgtatacacagatgtgcgaccacaggctgatgagcgcggccattaaggattccaaagctgtgcacgcagacatggggtactggatcgaatcagagaagaatgaaacgtggaagctcgcccgtgctagtttcattgaggttaaaacctgtatctggccaaagtctcatactctgtggagcaacggagtgcttgaatccgagatgataatccccaaaatttatggcggtcctacatcacaacacaattaccggccaggctacttcacccagactgccgggccgtggcatttgggaaagctggagttagattttgacctctgcgaaggcacaaccgtagtcgtggatgagcactgcgggtatcgaggacccagcctgagaacgactaccgtgacaggcaaaatcattcacgaatggtgttgcaggtcttgtacccttcctccactgcgcttccggggtgaggacgggtgctggtacggaatggagatcagacccgtcaaggaaaaggaggaaaacttggttaggtccatggtgagtgcaggcagcgcggaggtagactctttttccctcggtatactgtgtgtgtcaattctaatcgaagaggtcatgcgcagtcgatggagccggaaaatgctgatgactggcacactcgccgtgttcctgcttttgatcatggggcagctgacctggaatgatttaattcgtctctgcatcatggttggagctaacgcctcggacagaatgggcatggggacaacttatctggcacttatggctacctttaagatgaggcctatgttcgccgtgggactgctatttcgcaaactcacgtcccgggaggtcctgttgctgacaattggcttatctctcgtggcaagcgttgaactgccaaattcacttgaggaactgggtgatgggttggccatgggaataatgatgctcaagctgctaaccgacttccaaccccatcagctgtggactacccttctcagtctgacatttatcagaacttccttgtctctggattacgcttggaaaaccatggcgatggccttaagcattgtgtccctcttcccgctgtgtctttcaacgacaagccagaagaccacttggctgcctgtcttgctcggcagttttggctgcaagccactgacaatgttcctaatcaccgagaacaaaatttgggggaggaagtcttggcccatcaacgaaggaataatggcagtaggtatcgtgtccattctgcttagctcgctcctgaaaaatgacgttcctttggctggccccttaatcgccgggggaatgctgattgcctgttatgtgatctcaggctctagtgctgatctctccctggagaaggcagccgaggtcagctgggaagaggaagcggagcactctggtactagccataacatacttgtggaagtacaggacgatgggacaatgaaaattaaggacgaggagcgagatgacaccctgacgatcttgctaaaagctactctgctcgccgtgtccggagtctacccaatgtcaatccctgcaaccctgtttgtttggtatttctggcaaaagaagaaacagcgcagtggcgtgctttgggatacacccagcccaccggaagtggagcgggccgtcttagacgacggcatttacagaatactgcagagggggctcttgggacgttctcaggtgggtgttggcgtattccaagatggggtgtttcacaccatgtggcatgtcacacgcggagctgtgctgatgtaccagggcaagcggctcgaaccttcctgggcatcagttaaaaaggacctgatcagttatggtgggggatggagattccagggcagctggaatactggcgaggaggtgcaggtcattgccgtggaacccgggaaaaacccaaagaatgtacaaaccacgcccggaacatttaagactcctgagggtgaagtcggcgcgatcgctcttgatttcaaaccagggacctccggatctcccattgtgaacagggagggcaagatcgttggtctgtacgggaatggagtggtcacaacctcgggcacttatgtgagcgccatagcacaggccaaggcttcacaggaaggccctttgccggagatcgaggacgaagtttttaagaaacgaaacctaaccattatggatctgcacccagggtccggaaagacacggcgctacctccccgccatcgtgagagaggcaattaagaggaaattacggacgctgatccttgctcctactcgagtcgtggccagtgaaatggcggaggccctgaagggtatgccaataagatatcaaaccacagcagtaaaatctgaacacaccggccgcgagattgtggacctcatgtgccatgctactttcacaatgaggttgctgagccccgttcgtgtccctaattacaacatgatcatcatggatgaggcccactttaccgacccggcttccattgcagcccgggggtatatctcaacgagagtgggaatgggcgaagccgctgcgatattcatgactgcaacacccccaggttctgtggaggcctttcctcagagcaatgctgtcattcaggatgaagagagggacatccccgaacgcagttggaactccgggtacgattggattaccgacttcccaggaaagaccgtatggtttgtgcctagcatcaaatctggcaatgacatagccaactgtctccgaaagaatggcaagagagttattcagctgtcacggaaaactttcgatacagagtaccaaaagaccaaaaacaacgactgggattatgtggtcacaactgacatctccgagatgggggcaaatttcagggccgatcgcgtgatcgacccccgtagatgccttaagccagttattctaaaagatggaccggaacgggtgatcctggctggtcctatgcccgtcacggtggcgagtgccgcacagaggcgcggccgaattgggagaaaccagaataaggagggagaccagtacatatatatgggccaaccattgaacaatgatgaagaccatgctcactggaccgaggccaagatgttactggataacatcaatacacccgagggtattatccctgcactctttgaaccagagcgggagaaaagcgccgctatcgacggggagtacaggctgcgcggcgaagccagaaagactttcgtagagcttatgaggcggggagatctgcccgtgtggctctcgtataaagttgcgtctgagggctttcagtactccgaccgtcgctggtgcttcgacggggaacgaaacaatcaggtcttggaggaaaacatggatgtggagatttggaccaaggaaggagagaggaaaaagctgaggcctcggtggctagacgcacgcacatatagcgatccgctggccctcagagagtttaaagagttcgctgccggtaggcggtcagtgagtggcgaccttatactggagatcgggaagttaccacagcatttgaccctgcgagctcaaaatgcactcgataacctggtcatgcttcacaattctgaacagggaggcaaggcctacagacacgctatggaggaactgcccgacactattgagacgctcatgttgctggccttaatcgcagttctaaccggtggggtgacactgtttttcctctccggcaaaggacttggcaagactagcattgggctgttgtgtgtaatggcgtcaagtgccctgctctggatggctagcgtggagcctcattggatcgccgcatccataatcctggaatttttccttatggtcctcctgattcccgagccagatcgccagaggacccctcaggacaaccaattggcttacgtggttatcggactgttatttatgattctaacagtggccgcaaatgaaatgggtctgctcgagaccactaaaaaggatcttggcatcgggcacgtcgccgctgagaaccatcaccacgcgacaatgctggacgtagatttgcggcccgcctctgcatggacgctgtatgctgtggccaccactgttataacaccaatgatgcgtcataccattgaaaacaccacagccaatatcagcctcactgcaattgctaaccaggccgcgatcctgatgggacttgacaaaggctggcctatatccaagatggatatcggtgtgccgttactggctctcgggtgctactcacaggtcaatcccttgacgctgaccgccacagtgctaatgctggtcgcacactatgccattatcggcccaggactccaagctaaggcaactagagaggcccagaaaaggaccgcggctggcattatgaagaaccctacagtggacgggatcgttaccatagaccttgatcccgtggtatacgacgccaaattcgaaaagcagctgggacagattatgttgctgatcctctgtacttctcaaatcctgttaatgcgcacgacatgggcactttgcgagagtattaccctggccactggcccactcaccacactatgggaaggttcgcctgggaaattttggaatactaccatcgctgtgagcatggccaacatattccggggatcctatctggcaggcgctggtttggccttctctctgatgaagtcactcggcgggggacgaagaggcacaggggcgcagggagagacgcttggcgagaagtggaaaaggcagctgaatcagttgagcaagtccgaatttaacacctacaaaaagagtggtattatggaggtcgatcgctctgaagccaaagaggggctgaagcggggagaaactacaaagcatgcagttagcagaggcaccgctaaactccgttggttcgtggagaggaatttagtcaagcccgagggtaaagtgatcgacctgggctgtgggcggggaggctggtcatattactgcgccgggcttaagaaagtaactgaagtgaagggatacacaaaaggcggtccggggcacgaggaaccaattcctatggcaacctatggatggaacctggttaagctacattccggcaaggatgtgtttttcacgcccccagagaaatgtgacaccctcctgtgcgatatcggcgaaagtagccccaatcctacaatagaggaggggcgcactttgcgagtcctgaagatggtggaaccgtggctcagaggaaaccaattttgtatcaaaattcttaatccctacatgccatctgtcgtggagaccctggaacagatgcagaggaagcacggtggcatgttagttcggaaccctctgtcccgcaattcaacacacgagatgtattgggtaagctgcgggactggaaacatcgtgtcggctgtcaatatgacctctagaatgttgctcaacaggttcacaatggcccatcgaaaacccacctacgagcgggacgtggatctgggcgccggtactcgtcacgttgcggtggaacctgaggtcgctaacctagacattatcgggcagagaattgaaaatatcaagaacgagcataagagtacgtggcactatgatgaagacaatccatacaaaacatgggcatatcacggatcctacgaggtgaagcccagcggctcagcctcctctatggtaaacggcgtggttcgccttctgaccaaaccttgggacgtcataccaatggtgactcaaattgctatgaccgatacaacgccctttgggcagcagagggtgttcaaggagaaagtcgacacccggactccgagagccaagcgcggaacagcacaaatcatggaagttaccgccaagtggctctggggttttctgagcaggaataaaaagcctcgaatctgtactcgggaggagttcacaagaaaagtgaggagtaacgctgcgattggcgccgtatttgtggatgagaatcagtggaactccgcaaaggaagctgtcgaggacgagcgcttctgggatttggtgcatcgtgaacgggagctgcacaaacaggggaagtgcgcaacctgcgtttacaatatgatgggaaagagagagaaaaagctcggcgagtttggtaaagcaaaggggagcagggccatatggtatatgtggcttggagctcgcttcctggagttcgaggccttaggctttatgaacgaggaccattggttctctcgagaaaattcactgagtggcgtggagggggaaggattgcacaaactcggttacatcctgcgggatatttccaagatcccaggcgggaacatgtatgcggacgatacagcaggatgggacactagaattaccgaggatgacctacagaatgaggccaaaatcacggatataatggaacccgagcatgcacttctggccaccagcatctttaagctcacataccaaaacaaggtcgtgagggtacagcgccctgcaaaatctggcactgttatggacgtgatttcgagacgggaccagaggggttcagggcaggtcggaacctatggcctgaatacattcactaacatggaagtgcaattgatccgtcagatggagagcgaaggcatattttccccaagtgagttagagacccccaacctggctaagcgagtgctcgattggcttgaaaaacacggggccgagcgcctgaagagaatggctatctctggagacgattgtgtcgttaaaccgatagacgatcggttcgccacggcactaacagcgctgaatgacatgggtaaggtgaggaaggatattcctcagtgggaacccagcaaaggctggaacgactggcagcaagtaccattttgctcccaccatttccaccagctcatcatgaaggatgggcgcgacatcgtggtcccttgtagaaatcaggatgagttggtgggacgggccagggtttcacagggcgctggttggagtctgcgagaaaccgcctgccttgggaaatcttacgcacaaatgtggcagctgatgtattttcatcgtagagacctccgcttagctgccaacgcaatttgtagcgccgtgcccgtcgactgggtgccaacttcccggacaacctggtcaatacacgcgcaccatcagtggatgactaccgaggatatgctgagcgtatggaatagggtttggatcgaggaaaacccctggatggaggacaagacacacgtgtcttcctgggaagaggtcccttacttgggaaaaagagaagatcaatggtgcggcagtctgattggcctcacggctcgcgccacctgggcaactaatatccaggtggccattaaccaggttcggaggcttatcgggaatgagaactacctggactatatgacaagcatgaagcgattcaagaatgagtcggatccagaaggagctctatggtga

SEQ ID NO: 13234 - RNA, 9879 nt, synthetic construct
  misc_feature 1..9879: note = derived and/or modified CDS sequence (opt3) from DENV-1__FJ850087__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagttggtgtgaacatgtgcacactcattgcaatggacctgggcgagctttgtgaagatactatgacctacaaatgcccacggataacagaggccgaaccggacgatgtagactgttggtgcaatgcgaccgatacttgggtgacatatgggacctgtagtcaaacgggagagcaccgccgagacaagcgtagcgtcgctctggccccccatgtgggcttgggtctcgagactagaaccgaaacatggatgtcctctgagggggcatggaaacagatccagaaggttgaaacttgggccctgaggcaccctggattcaccgtgattgctctgtttctcgcacatgccatcggcacatcgattacccagaagggcatcatattcatcttactgatgcttgtcacgccatcaatggctatgcggtgcgtggggattggaaaccgcgattttgtagagggtttgagcggcgccacttgggttgacgtggtcctggagcacgggagttgtgtgacaaccatggcgaaaaataagcccactctagatatcgaactcctgaaaacagaggtgaccaaccctgcagtccttagaaagctgtgcattgaagccaaaatctccaatacgaccacagactctaggtgtccaactcaaggagaggctaccttggttgaagagcaggatgccaacttcgtgtgccggcgcacatttgtagaccgaggctggggtaatgggtgtggactcttcggcaagggcagcctgttaacttgcgcaaagtttaaatgcgtgaccaagctggaggggaaaatagtccagtacgaaaacctcaagtattccgtgattgttacagtgcacaccggagatcagcatcaagtcggtaatgagactacggaacacggcacaatcgctaccattactccccaggcccctacctcagagatccagcttacagactacggggcgctgaccttggactgtagtccaagaactggactagatttcaacgaaatggtgctgctcacaatgaaagagaagagctggctggtacataaacagtggtttcttgacctgccgttgccctggacgtctggcgcctccacctcacaagagacttggaataggcaggatctcctggttacattcaagaccgcacacgctaagaaacaggaagtggtcgtgttaggtagccaagagggggccatgcacacagctctgactggcgccaccgaaatccagacgagtggaaccacaactatttttgcaggccatctaaagtgccggctcaaaatggacaagctgacccttaaagggatgtcttatgtcatgtgtacaggatccttcaagttggagaaggaagtggccgagactcagcacggtaccgttctggtgcaggtaaaatacgagggcacggatgctccttgcaagataccattcctcacacaagacgaaaaaggggtcacccagaacggacgtctgatcactgcgaatcccattgtgacagataaggagaaacctgttaacatcgaaaccgagccaccctttggcgagagctatatagtggtcggtgcaggggaaaaggcccttaagctgtcgtggttcaaaaagggctcttccattggaaaaatgtttgaggctactgcccgcggcgcaagaaggatggccatcttgggggacaccgcttgggatttcggatcaatcggtggcctctttacaagtgtggggaagctgattcatcaggtattcggaacggcctacggcgtgttatttagcggtgtttcctggaccatgaaaatcgggattggcatactgctaacttggctcggactgaattctcggagcacatcacttagtatgacctgtatcgcagtcggcatggtgacattgtacctgggggtgatggtccaggcggactccggatgcgttattaactggaagggccgagaactcaagtgtggtagcgggatcttcgtgactaacgaggtgcacacctggacggaacaatataaatttcaggctgattctccgaagcgcctgtcagccgcaatcggaaaagcctgggaggagggcgtatgcggtattagaagtgctacaaggttagaaaatataatgtggaagcagatcagcaacgagctgaattacattcttttggaaaacgacatgaaattcaccgtcgtggttggcgacgtgaatgggatcctcgcccagggaaagaaaatgattcggcctcaacccatggagcataagtattcctggaagtcttggggcaaagcaaagatcataggggctgatatccagaacactacctttattatcgacggaccagatacacctgaatgtcccgacgatcagcgcgcctggaatatttgggaggtcgaggactacggcttcggtatctttactaccaacatatggctgaaactaagagattcgcacacacagatgtgcgaccacaggctgatgagcgcggccattaaggattccaaagctgtgcatgcagacatggggtattggatcgaatcagagaagaatgaaacgtggaagctcgcccgtgctagtttcattgaggttaaaacctgtatctggccaaagtctcacactctgtggagcaacggagtgcttgaatccgagatggtaatacccaaaatctacggcggtcctatttcacaacataattatcggccaggctacttcacacagaccgccgggccgtggcacttgggaaagctggagttagattttgacctctgcgaaggcactacagtcgtggtggatgagcactgcgggtaccgaggacccagcctgagaaccacgactgtcaccggcaaaatcattcatgaatggtgttgcaggtcttgtacacttcctccactgcgcttccggggtgaggacgggtgctggtatggaatggagatcagacccgttaaggaaaaggaggaaaacttggtgaggtccatggtaagtgcaggcagcggtgaggtggactctttttccctcggcatactgtgtgtctcaattctaatcgaagaggtgatgcgcagtcgatggagccggaaaatgctgatgaccgggactctcgttgtgttcctgcttttgatcatgggacagctgacatggaatgatttaattcgtctctgcatcatggtcggcgcgaacgcctcggacagaatggggatgggaaccacatacctggctcttatggccacttttaagatgaggcctatgttcgcagtgggcctgctatttcgccggctcacctccagagaggttctgttgctgacggtgggtttatctctcgtcgctagcgtagaactgccaaattcacttgaggaactgggggatggattggccatgggcattatgatgctcaaactgctaacagacttccaaccccaccagctgtggaccactcttctcagtctgacctttataaggacatccttgtctctggattatgcatggaagactatggccatggctttaagcatcgtgtccctcttcccgctgtgtctttcaaccacgagccagaaaacaacctggctgcctgttttgctcggcagttttgggtgcaagccactgactatgttcctaattacagagaacaagatctggggacgaaaatcttggcccattaacgaaggtatcatggcggtgggcatagtctccatcctgcttagctcgctcctgaagaatgacgtgcctttggccgggcccttaattgcaggaggcatgctgatcgcttgttacgtaatttcaggttctagtgccgatctctccctggagaaagccgctgaggtgagctgggaagaggaagcagagcattctgggaccagccacaacatccttgtcgaagttcaggacgatggaactatgaagataaaagacgaggagcgcgatgacacactgaccattttgctaaaggccacgctgctcgcggtgtccggcgtgtatccaatgtcaatccctgctactctgtttgtctggtacttctggcaaaaaaagaagcagcggagtggcgtgctttgggatacccccagcccaccggaagttgagagagccgtattagacgacgggatctataggattctgcagcgtggactcttgggtcgctctcaggtgggcgtcggggtgctgcaagatggagttttccatacaatgtggcacgtgacccggggcgcagtcctcatgtaccagggtaaaagactggaaccttcctgggcctcagtgaagaaagaccttataagttacgggggaggctggaggtttcagggcagctggaatacaggggaggaggtacaggtcatcgctgtggaacccggaaagaacccaaaaaatgttcaaactacccccggtacgttcaagacacctgagggcgaagtgggggcaattgccctggattttaagccaggaacttccggctctcccatcgtcaaccgagagggtaaaattgtggggttgtatggaaatggcgttgtgaccacatcgggcacctacgtcagcgcgatcgctcaggccaaggcaactcaggaagggcctctaccggagatagaggacgaagtgttcaaaaagcggaacctgaccatcatggatctccacccaggatcaggtaaaacacgcagatatttacccgccattgtaagggaggctatcaagcggaagctgcgaacgcttattctggcccctactagagtggttgcatccgaaatggctgaggccctcaaaggcatgccaatccgctaccaaaccacagcggtcaagagtgaacataccgggagggagatagtggacttgatgtgccacgccacttttacaatgcgtctgctctctcccgtgcgggtccctaattataacatgattatcatggatgaggcacatttcaccgacccggctagcatcgccgctagaggatacatttccacgagggtaggcatgggtgaagcagccgccatctttatgactgctacacccccagggtcagtggaggcgttccctcagtctaatgcagttatacaggatgaagagcgcgacattcccgaacgaagctggaacagtggatatgattggatcaccgactttccaggcaaaaccgtgtggttcgtcccttccattaagagcggcaatgacatcgccaactgtctgagaaaaaatgggaagcgggtgatacagctttctaggaagacttttgatacagagtaccaaaaaaccaagaacaacgactgggattacgttgtgacaactgacatttcagagatgggagctaatttccgcgccgatcgtgtcatcgaccccagacggtgcctaaaaccagtgatcctgaaggaaggtccggagagggtaattttggcaggccctatgcccgtgacggttgcctccgctgcgcagcgccgagggagaatcggacggaaccagaataaagaaggcgatcagtatatttacatgggtcaaccattaaacaatgacgaggatcacgcccattggaccgaggcaaagatgctgctcgacaacataaatacacccgaagggatcattcctgctctgttcgagccagaaagggagaagagtgccgcaatcgatggcgaatatcgccttagaggagaggccaggaaaacttttgtcgagctgatgcggcgtggcgacctccccgtgtggttgagctacaaggtggcttcggaagggttccagtattctgatcgccgatggtgctttgacggagagagaaacaatcaggtcctggaagagaacatggacgttgaaatctggaccaaagagggtgagaggaagaaactacggcctcgctggctggatgccagaacatactccgacccgctcgcgcttagggaattcaaggagtttgcagccggccggcgaagcgtgtcaggggatctgattttagaaataggaaaattgccacagcacctgaccctcagagctcaaaatgccctggacaaccttgtaatgctgcacaatagtgagcagggcggtaaggcttatcgccatgcaatggaagagctccccgatactatcgagacgttgatgctgttagccctaattgctgtgctgaccgggggcgtcacactcttctttctttctggaaagggcctggggaaaacttccatcggattgctgtgtgtgatggccagctcagcactcctgtggatggcgagtgttgaacctcactggattgccgctagcatcatacttgagttctttctcatggtgctgttgatccccgaaccagacaggcagcggacccctcaggataaccaactggcctacgtcgtaattggtttactattcatgatcctgacagtggcagctaatgagatgggcctccttgagaccactaagaaagacctggggattggacatgttgccgtggaaaaccaccaccatgcaacaatgttggatgtcgacctgcgtcccgcctccgcttggacgctctacgcggtggccaccactgtcatcacaccaatgatgagacacaccatagagaacaccacagcaaatatttctctgactgctatcgccaaccaggccgcaattcttatgggcttagataagggttggcctatcagcaaaatggacataggggtgccgctgctcgctttgggctgctattcccaggttaatcccctgacgctaaccgccgcggtgctgatgctcgtagctcattacgccatcattggaccaggccttcaagcaaaggccacaagggaagctcagaagcgcactgcagccgggatcatgaaaaaccctaccgtggatggaattgtcacaatcgacctggaccccgttgtgtatgatgcgaagtttgagaaacagttgggccagataatgctgctcattctgtgtacctcacaaatcttacttatgcggactacgtgggctctgtgcgaatctatcacactcgccaccggtccactaactaccctgtgggaggggagtcctggaaagttctggaatacaactattgcagtctcgatggccaacatctttcgaggcagctacttggctggtgccggcctggcattctccctcatgaaatctcttgggggaggcagaagggggaccggagctcagggcgagacactgggtgaaaagtggaagcgccagttgaatcagctgtcaaaaagcgagttcaacacgtataagaaatccgggataatggaagtggaccggagtgaggccaaggaaggactcaaaagaggcgagaccactaagcacgcggtatctcgtggtacagccaagttaaggtggtttgtggagcggaatctggttaaacccgaaggcaaggtgattgatcttgggtgtggacgcggcgggtggagctactattgcgcaggactgaaaaaggtcaccgaggtgaaaggctacactaagggtgggccgggacatgaagagccaatccctatggctacatacggctggaacctagtcaaactccactcaggcaaggacgtgttctttacccccccagaaaagtgtgatacgctgttgtgcgacattggggagtccagtcccaatcctaccatcgaggaaggacgaacactgagagttctcaaaatggtagagccgtggcttaggggtaaccaattctgtataaagatcctgaatccctatatgccaagcgtggtcgaaactttagagcagatgcagcggaaacacggcgggatgctggtgcgcaaccctttgtctagaaattccacccatgagatgtactgggtttcatgcggaacaggcaacattgtgagcgccgtcaatatgacttcgaggatgctcctgaaccgatttaccatggcacaccggaagcccacatatgaacgtgatgtggacctaggtgctgggaccagacatgtagccgtggagcctgaagttgccaaccttgatatcattggacagcgcatcgagaatattaaaaacgaacacaagtctacttggcactacgacgaggataatccatataagacgtgggcgtaccatggcagttatgaggtcaaaccctccggcagcgcttcatccatggtgaacggggtggtcaggctgctcacaaagccttgggacgttatcccaatggtgacccaaatagcaatgactgacaccacacccttcggacagcagcgggtatttaaagaaaaggtggatacgagaaccccgcgcgccaaaaggggtactgctcaaattatggaggtcacagccaagtggctgtggggcttcttgtctcgaaataagaaacctcggatctgtaccagagaagagtttactaggaaggtgcgcagcaacgcagccatcggggctgttttcgtggacgaaaatcagtggaacagtgcgaaagaggccgtcgaggatgaacgtttttgggacctggtgcaccgggagagagaactccataagcagggaaaatgcgcaacatgcgtatacaatatgatgggcaagagggagaagaaacttggtgaattcgggaaggctaaaggatcccgcgccatttggtacatgtggctgggcgcacgatttttagagttcgaggccctgggcttcatgaacgaagatcactggtttagccgggagaattctttgtcaggggttgaaggagagggtctccataagctgggctatatactaagagacatcagtaaaattccagggggaaacatgtacgctgatgacaccgccggctgggatacaaggatcactgaggacgatcttcagaatgaagcgaagattaccgacatcatggagcccgaacacgcactgctcgccacgtccatattcaaactgacctatcaaaacaaggtggtccgcgtgcagagacctgctaagagcggtacagtgatggatgtcatctctcggagggaccagcgtgggtcgggacaggttggcacttacggcttgaatacctttacaaacatggaggtgcaattaattcgacagatggaatcagaggggatcttcagcccatccgagctggaaactcccaacctcgccaaaaaggtacttgactggctggagaaacacggagcagaacgcctaaagagaatggctattagtggtgatgactgtgtggtcaaaccgatcgatgaccggtttgccaccgctctgacggccctcaatgatatgggcaaggtgaggaaggacatacctcagtgggagccctctaaagggtggaacgattggcagcaagttccattctgcagccatcactttcatcagttgattatgaaggacggacgcgaaatcgtggtcccttgtagaaatcaggatgagctggtgggccgggcaagggtatcccagggtgcggggtggtcacttcgagagacagcctgcctgggaaaaagttatgctcaaatgtggcagctcatgtacttccaccgtagagacttacgcctggccgcaaacgctatctgttctgccgttcccgtggattgggtcccaaccagccggactacatggtccattcacgcacatcaccagtggatgaccactgaagacatgttgtcagtgtggaatagggtttggatagaggaaaacccctggatggaggacaagacccatgtgagctcttgggaagaggtcccttatctgggcaaaagagaggatcaatggtgcggctccctcatcgggcttacagcccgcgcgacgtgggctaccaatattcaggtggccatcaaccaggtacggaggctgattggaaatgaaaactacctagactacatgactagtatgaagcgatttaagaatgagagcgatccagaaggtgcactgtggtga

SEQ ID NO: 13235 - RNA, 9879 nt, synthetic construct
  misc_feature 1..9879: note = derived and/or modified CDS sequence (opt3) from DENV-1__FJ850090__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagttggtgtgaacatgtgcacactcattgcaatggacctgggcgagctttgtgaagatactatgacctacaaatgcccacggataacagaggtagaaccggacgatgtggactgttggtgcaatgccaccgatacttgggtcacatatgggacctgtagtcaaacgggagagcaccgccgagacaagcgtagcgtggcgctggctccccatgttggcttgggtctcgagactagaaccgaaacatggatgtcctctgagggggcctggaaacagatccagaaggtggaaacttgggcactgaggcaccctggattcaccgtcattgccctgtttctcgctcatgcaatcggcacatcgattacccagaagggcatcatattcatcttactgatgcttgtgacgccatcaatggccatgcggtgcgtagggattggaaaccgcgattttgttgagggtttgagcggcgctacttgggtggacgtcgtgctggagcacgggagttgtgtgacaaccatggccaaaaataagcccactctagatatcgaactcctgaaaacagaggtcaccaaccctgcggttcttagaaagctgtgcattgaagcaaaaatctccaatacgaccacagactctaggtgtccaactcaaggagaggccaccttggtggaagagcaggatgctaacttcgtatgccggcgcacatttgtggaccgaggctggggtaatgggtgtggactcttcggcaagggcagcctgttaacttgcgccaagtttaaatgcgtcaccaagctggaggggaaaatagtgcagtacgaaaacctcaagtattccgttattgtgacagtccacaccggagatcagcatcaagtgggtaatgagactacggaacacggcacaatcgcaaccattactccccaggctcctacctcagagatccagcttacagactacggggccctgaccttggactgtagtccaagaactggactagatttcaacgaaatggtactgctcacaatgaaagagaagagctggctggttcataaacagtggtttcttgacctgccgttgccctggacgtctggcgcgtccacctcacaagagacttggaataggcaggatctcctggtgacattcaagaccgcccacgcaaagaaacaggaagtcgtggtcttaggtagccaagagggggctatgcacacagccctgactggcgctaccgaaatccagacgagtggaaccacaactatttttgccggccatctaaagtgccggctcaaaatggacaagctgacccttaaagggatgtcttatgtgatgtgtacaggatccttcaagttggagaaggaagttgcagagactcagcacggtaccgtgctggtacaggtcaaatacgagggcacggatgccccttgcaagataccattcctcacacaagacgaaaaaggggtgatccagaacggacgtctgattaccgctaatcccatcgttactgataaggagaaacctgtgaacatagaaacagagccaccctttggcgagagctatattgtcgtgggtgcgggggaaaaggcacttaagctgtcgtggttcaaaaagggctcttccatcggaaaaatgtttgaggccaccgctcgcggcgccagaaggatggcaatcttgggggacactgcctgggatttcggatcaattggtggcctctttaccagtgtagggaagctgatccatcaggtgttcggaacagcttacggcgttttatttagcggtgtctcctggacgatgaaaattgggataggcatcctgctaacctggctcggactgaattctcggagcacttcacttagtatgacatgtattgccgtgggcatggtgaccttgtacctgggggtcatggttcaggcagactccggatgcgtgatcaactggaagggccgagaactcaagtgtggtagcgggatcttcgtgacaaacgaggtacacacttggaccgaacaatataaatttcaggcggattctccgaagcgcctgtcagctgccattggaaaagcatgggaggagggcgtctgcggtataagaagtgccacgaggttagaaaatatcatgtggaagcagattagcaacgagctgaattacatccttttggaaaacgacatgaaattcacagtggttgtgggcgacgctaatgggattctcacccagggaaagaaaatgatccggcctcaacccatggagcataagtattcctggaagtcttggggcaaagccaagataatcggggcagatattcagaacactacctttatcattgacggaccagatacacctgaatgtcccgacgatcagcgcgcttggaatatctgggaggtcgaggactacggcttcggtatatttactaccaacatttggctgaaactaagagattcgcacacacagatgtgcgaccacaggctgatgagcgccgcgatcaaggattccaaagccgtgcatgctgacatggggtattggattgaatcagagaagaatgaaacgtggaagctcgcacgtgccagtttcatcgaggttaaaacctgtatatggccaaagtctcacactctgtggagcaacggagtgcttgaatccgagatgatcattcccaaaatctacggcggtcctacatcacaacataattatcggccaggctacttcacccagactgctgggccgtggcacttgggaaagctggagttagattttgacctctgcgaaggcacaaccgtagtcgtggatgagcactgcgggtaccgaggacccagcctgagaacgactaccgtgacaggcaaaattatccatgaatggtgttgcaggtcttgtacccttcctccactgcgcttccggggtgaggacgggtgctggtatggaatggagataagacccgtcaaggaaaaggaggaaaacttggttaggtccatggtgagtgccggcagcggtgaggtagactctttttccctcggcattctgtgtgtgtcaatcctaatcgaagaggtcatgcgcagtcgatggagccggaaaatgctgatgactgggacactcgcagtgttcctgcttttgattatgggacagctgacctggaatgatttaatccgtctctgcattatggttggcgcgaacgcctcggacagaatggggatgggaacaacttacctggctcttatggccacctttaagatgaggcctatgttcgcagtgggcctgctatttcgcaaactcacgtcccgggaggtcctgttgctgacaataggtttatctctcgtggctagcgttgaactgccaaattcacttgaggaactgggggatggattggccatgggcatcatgatgctcaagctgctaaccgacttccaaccccaccagctgtggactacccttctcagtctgacatttattagaacttccttgtctctggattatgcatggaaaaccatggccatggctttaagcatcgtgtccctcttcccgctgtgtctttcaacgacaagccagaagaccacttggctgcctgtcttgctcggcagttttgggtgcaagccactgacaatgttcctaattaccgagaacaaaatctggggaaggaagtcttggcccataaacgaaggtatcatggcggtaggcattgtgtccatcctgcttagctcgctcctgaaaaatgacgttcctttggccgggcccttaattgcaggaggcatgctgatcgcttgttacgtgatatcaggttctagtgccgatctctccctggagaaggccgctgaggtcagctgggaagaggaagcagagcattctgggactagccacaacattcttgtggaagtacaggacgatggaacaatgaaaatcaaggacgaggagcgagatgacaccctgacgatcttgctaaaagccactctgctcgcggtgtccggcgtctatccaatgtcaattcctgctaccctgtttgtttggtacttctggcaaaagaagaaacagcgcagtggcgtgctttgggatacacccagcccaccggaagtggagcgggccgtcttagacgacgggatatatagaatcctgcagaggggactcttgggtcgttctcaggtgggcgttggggtattccaagatggagtgtttcataccatgtggcacgtcacacgcggcgcagtgctgatgtaccagggtaagcggctcgaaccttcctgggcctcagttaaaaaggacctgattagttacgggggaggctggagattccagggcagctggaatactggggaggaggtgcaggtcatcgctgtggaacccggaaaaaacccaaagaatgtacaaaccacgcccggtacatttaagactcctgagggcgaagtcggggcaattgcccttgatttcaaaccaggaacctccggctctcccatcgtgaacagggagggtaagatagttgggctgtatggaaatggcgtggtcacaacctcgggcacttacgtgagcgcgatcgctcaggccaaagcatcacaggaagggcctttgccggagattgaggacgaagtttttaagaaacgaaacctaaccatcatggatctgcacccaggatccggtaagacacggcgctatctccccgccattgtgagagaggctatcaagaggaaattacggacgctgatacttgcccctactcgagtcgtggcaagtgaaatggctgaggccctgaagggcatgccaattagataccaaaccacagcggtaaaatctgaacataccgggcgcgagatcgtggacctcatgtgccacgccactttcacaatgaggttgctgagccccgttcgtgtccctaattataacatgatcattatggatgaggcacattttaccgacccggcttccatcgccgctcggggatacatatcaacgagagtgggcatgggtgaagcagccgccattttcatgactgctacacccccagggtctgtggaggcgtttcctcagagcaatgcagtcatccaggatgaagagagggacattcccgaacgcagttggaactccggatatgattggatcaccgacttcccaggcaagaccgtatggtttgtgcctagcataaaatctggcaatgacattgccaactgtctccgaaagaatgggaagagagttatccagctgtcacggaaaactttcgatacagagtaccaaaagaccaaaaacaacgactgggattacgtggtcacaactgacatctccgagatgggagctaatttcagggccgatcgcgtgattgacccccgtagatgccttaagccagttatcctaaaagatggtccggaacgggtgattctggcaggccctatgcccgtcacggtggccagtgctgcgcagaggcgcgggcgaataggaagaaaccagaataaggagggcgaccagtatatctacatgggtcaaccattgaacaatgatgaagaccacgcccattggaccgaggcaaagatgttactggataacattaatacacccgaggggatcatccctgctctctttgaaccagagcgggaaaaaagcgccgcaattgacggcgagtataggctgcgcggagaagccagaaagactttcgtagagcttatgaggcggggcgatctgcccgtgtggctctcgtacaaagttgcttctgaggggtttcagtattccgaccgtcgctggtgcttcgacggagaacgaaacaatcaggtcttggaggaaaacatggatgtggagatatggaccaaggaaggtgagagaaaaaagctgaggcctcggtggctagacgcccgcacatacagcgatccgctggcgctcagagagtttaaagaattcgcagccggcaggcggtcagtgagtggggaccttatcctggagattggaaagttaccacagcacttgaccctgcgagctcaaaatgccctcgataacctggtcatgcttcacaattctgaacagggcggtaaggcttatagacatgcaatggaggaactgcccgacactatcgagacgctcatgttgctggccttaattgctgttctaaccgggggcgtgacactgtttttcctctccggaaaaggccttgggaagactagcatcggactgttgtgtgtaatggcctcaagtgcactgctctggatggcgagcgtggagcctcactggatagccgcttccatcattctggaatttttccttatggtcctcctgatccccgagccagatcgccagaggacccctcaggacaaccaattggcctacgtggttattggtctgttatttatgatcctaacagtggcagctaatgaaatgggcctgctcgagaccactaaaaaggatcttgggataggacatgtcgccgcagagaaccaccaccatgccacaatgctggacgtagatttgcggcccgcttctgcgtggacgctgtacgccgtggcaaccactgttattacaccaatgatgcgtcacaccatcgaaaacaccacagctaatattagcctcactgccatcgccaaccaggcagctatactgatgggccttgacaaaggttggcctatctccaagatggatattggggtgccgttactggccctcggctgctattcacaggtcaatcccttgacgctgaccgcgacagtgctaatgctggtcgctcattacgccatcattggaccaggcctccaagcaaaggccactagagaggctcagaaaaggaccgcagccgggatcatgaagaaccctacagtggacggaatagttaccattgaccttgatcccgtggtatatgacgcgaaattcgaaaagcagctgggccagatcatgttgctgatcctctgtacttctcaaattctgttaatgcgcacgacatgggctctttgcgagagtatcaccctggccactggtccactcaccacactatgggaagggtcgcctggaaaattttggaatactaccatagcagtgagcatggccaacattttccggggctcctacctggctggtgccggcttggcattctctctgatgaagtcactcgggggaggccgaagagggacaggagctcagggcgagacgcttggtgagaagtggaaaaggcagctgaatcagttgagcaagtccgaatttaacacctataaaaagagtgggatcatggaggtcgatcgctctgaagccaaagagggactgaagcggggcgaaactacaaagcacgcggttagcagaggtaccgccaaactccgttggttcgtggagaggaatttagtcaagcccgagggcaaagtgattgacctggggtgtggacggggcgggtggtcatactattgcgcaggacttaagaaagtaactgaagtgaagggctacacaaaaggtgggccgggacatgaggaaccaatccctatggctacctacggctggaacctggttaagctacactccggcaaggatgtgtttttcacgcccccagagaaatgtgacaccctcctgtgcgatataggggaaagtagccccaatcctacaatcgaggagggacgcactttgcgagtcctgaagatggtggaaccgtggctcagaggtaaccaattttgtattaaaatccttaatccctatatgccatctgtcgtggagaccctggaacagatgcagaggaagcacggcgggatgttagttcggaaccctctgtcccgcaattcaacacatgagatgtactgggtaagctgcggaactggcaacattgtgtcggccgtcaatatgacctctagaatgttgctcaacaggttcacaatggcacaccgaaaacccacctatgagcgggacgtggatctgggtgctgggactcgtcatgttgccgtggaacctgaggtcgccaacctagacatcattggacagagaatcgaaaatataaagaacgagcacaagagtacgtggcactacgatgaagacaatccatataaaacatgggcgtaccatggctcctatgaggtgaagcccagcggctcagcttcctctatggtaaacggggtggttcgccttctgaccaaaccttgggacgtcattccaatggtgactcaaatcgcaatgaccgatacaacgccctttggacagcagagggtgttcaaggagaaagtcgacacccggactccgagagccaagcgcggtacagctcaaatcatggaagttaccgccaagtggctctgggattttctgagcaggaataaaaagcctcgaatttgtactcgggaggaattcacaagaaaagtgaggagtaacgcagccataggcgctgtatttgtggacgagaatcagtggaactccgcgaaggaagccgtcgaggatgagcgcttctgggacttggtgcaccgtgaacgggagctgcataaacaggggaagtgcgcaacctgcgtttacaatatgatgggaaagagagaaaaaaagctcggcgagtttggtaaagctaaggggagcagggccatctggtacatgtggcttggagcacgcttcctggaattcgaggccttaggctttatgaacgaggatcactggttctctcgagaaaattcactgagtggcgtggagggggaaggattgcataaactcggttatattctgcgggacatctccaagattccaggcgggaacatgtacgctgatgacacagccggatgggatactagaatcaccgaggacgatctacagaatgaggcgaaaataacggacatcatggaacccgagcacgcacttctggccaccagcatttttaagctcacatatcaaaacaaggtcgtgagggtacagcgccctgctaaatctggcactgttatggacgtgatctcgagacgggatcagaggggttcagggcaggtcggaacctacggcctgaatacattcactaacatggaagtgcaattgattcgtcagatggagagcgaaggcatcttttccccaagtgagttagagacccccaacctggccaagcgagtgctcgactggcttgaaaaacacggggcagagcgcctgaagagaatggctatatctggagatgactgtgtcgttaaaccgattgatgaccggttcgccacggctctaacagccctgaatgatatgggtaaggtgaggaaggacatccctcagtgggaacccagcaaaggctggaacgattggcagcaagtaccattttgctcccatcacttccatcagctcatcatgaaggacgggcgcgatattgtggtcccttgtagaaatcaggacgagttggtgggacgggcaagggtttcacagggcgcgggttggagtctgcgagaaaccgcctgccttgggaaatcttatgctcaaatgtggcagctgatgtactttcaccgtagagacctccgcttagccgcaaacgctatatgtagcgccgtgcccgtcgattgggtgccaacttcccggacaacctggtcaatccacgcacatcaccagtggatgactaccgaggacatgctgagcgtatggaatagggtttggattgaggaaaacccctggatggaggataagacacatgtgtcttcctgggaagaggtcccttatttgggaaaaagagaagaccaatggtgcggcagtctgatcggcctcacggcccgcgcgacctgggctactaatattcaggtggccatcaaccaggttcggaggcttatagggaatgagaactacctggattacatgacaagcatgaagcgattcaagaatgagtcggacccagaaggagcactatggtga

SEQ ID NO: 13236 - RNA, 9879 nt, synthetic construct
  misc_feature 1..9879: note = derived and/or modified CDS sequence (opt3) from DENV-1__FJ850093__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaaacagatccagagggtggaaacttgggctctgcggcaccctggattcaccgttattgcactgtttctcgcccatgctatcggcacatcgattacccagaagggcatcatattcatcttactgatgcttgtgacgccatcaatggccatgcgctgcgtcgggattggaaacagagattttgtggagggtttgagcggcgcgacttgggtagacgttgtgctggagcacgggagttgtgtcacaaccatggcaaagaataaacccactctagatatcgaactcctgaagacagaggtgaccaaccctgccgtgcttaggaaactgtgcattgaagctaagatctccaatacgaccacagactctcggtgtccaactcaaggagaggccaccttggtcgaagagcaggatgcaaacttcgtttgccgccgaacatttgtggacagaggctggggtaatgggtgtggactcttcggcaaaggcagcctgttaacttgcgctaagtttaagtgcgtaaccaaactggaggggaagatagtgcagtacgaaaacctcaaatattccgtcattgtgacagttcacaccggagatcagcatcaagtgggtaatgagactacggaacacggcacaatcgccaccattactccccaggcgcctacctcagagatccagcttacagactacggggccctgaccttggactgtagtccaaggactggactagatttcaacgaaatggtcctgctcacaatgaaggagaaaagctggctggtgcataagcagtggtttcttgacctgccgttgccctggacgtctggcgcatccacctcacaagagacttggaatcggcaggatctcctggtaacattcaaaaccgctcacgccaagaagcaggaagttgtggtcttaggtagccaagagggggctatgcacacagccctgactggcgcaaccgaaatccagacgagtggaaccacaactatttttgccggccatctaaaatgccgtctcaagatggacaaactgacccttaaggggatgtcttatgtgatgtgtacaggatccttcaaattggagaaggaagtcgctgagactcagcacggtaccgtgctggttcaggtgaagtacgagggcacggatgcgccttgcaaaataccattcagcacacaagacgaaaagggggtaacccagaacggacgcctcatcactgcaaatcccattgtcacagataaagagaagcctgtgaacatcgaaaccgagccaccctttggcgagtcgtatatagttgtgggtgccggggaaaaagctctgaagctttcttggttcaagaaaggctcctcaattggaaagatgtttgaggccactgcaagaggcgccaggcggatggctatcctgggggacaccgcctgggatttcggaagtatcggtggcgtctttacaagcgtggggaaattggtacatcaggtgttcggaacggcatacggcgttctcttttccggtgtctcttggaccatgaagattgggatcggcattctgttaacttggctgggactaaatagccgatcaacaagtctctccatgacctgtatagcggtgggcatggtgacactgtaccttggggtcatggttcaggctgacagcggatgcgtgatcaactggaaaggccgcgaattgaagtgtggttctgggattttcgtgactaacgaggtacacacctggacggaacaatataagtttcaggccgattcaccgaaaagactgagtgcagccatcggaaaggcttgggaggagggcgtctgcggtatcaggagcgccacacggctcgaaaatattatgtggaaacagatatccaacgagctgaatcatatcttactggaaaacgacatgaagttcaccgtggttgtgggcgacgcaaatgggattcttgctcagggaaaaaagatgatccgccctcaacccatggagcacaaatactcttggaagtcgtggggcaaggccaaaattatcggggcggatatacagaacactacctttatcattgacggaccagatacacctgaatgtcccgacggccagagagcctggaatatctgggaggtcgaggattatggtttcgggatttttactaccaacatctggttgaagctcagggacagctacacacagatgtgcgatcaccgtctgatgtccgctgcaataaaagactcaaaggccgtgcatgctgatatgggatattggattgaaagtgagaaaaatgaaacgtggaagctagcccgggcatctttcatcgaggttaagacctgtacttggccaaaaagccacacactgtggtccaacggcgtgctcgaatcagagatgattatccccaagatatacggtggccctatcagccaacataattatcgaccagggtacttcacccagactgcgggaccgtggcacctgggcaaacttgagttggactttgatctgtgcgaagggacaaccgtagtcgtggacgagcactgcggaaacagaggcccctctttaaggacgactaccgtgacaggtaagattatccatgaatggtgttgccgctcctgtaccctccctccactgcggttcagaggggaggatggatgctggtacggcatggagattaggcccgtcaaagaaaaggaggaaaatcttgttcgcagtatggtgagcgccggttctggcgaggtagactccttttcactggggatcttgtgtgtgagtataatgattgaagaggtcatgcgaagccggtggtcgcgtaagatgctcatgactggaacactggctgtgttcctactgctcatcatgggccagctgacctggaacgaccttatcagattgtgcattatggttggggccaatgcatccgataggatgggaatgggcacaactcacctggctttaatggccacctttaaaatgcgccctatgttcgcagtgggtctcctgtttcggagacttacgtctagggaggtcctgctactcacaatcgggctgagcttgatggcctcaatggaactgccaaacagtttagaggaactcggagacggcctggctatgggcattatgatgcttaagctgttgaccgagttccaaccccatcagctctggactaccctgctatccctgacatttgtgaaaactaccctttctctcgattatgcgtggaagacgacagccatgatactgagcatcgtttccttgttcccgctgtgtttatcaaccactagccagaaaacaacctggctccctgtgctgcttgggagttttggatgcaagccactgactatgttcttgattacagaaaacaagatctggggtcgaaaatcttggcccctcaatgagggcattatggcaatcgggatagtctccatcctgctaagctcgctgcttaagaacgacgtacctctcgctggacccctgattgccggcggtatgttgatcgcctgttacgtgatttcagggtctagtgctgatttatccctggagaaagcagccgaagttagctgggagcaggaagcggagcactctggagctagccataatatcctcgtggaagtccaagacgatggcaccatgaagataaaagacgaggagcgcgatgacacgctgactattcttctgaaggccaccttgctagcagtgtccggcgtatatccaatgtcaatccctgccacactgtttgtgtggtacttctggcagaaaaagaagcagcggagtggggtcctctgggatacccccagcccaccggaagttgagagagctgtgctggacgatggaatctataggattcttcagcgtggtttactgggccgctctcaagtgggggtcggagtgttccaggacggcgtttttcacacaatgtggcacgtaactcggggtgcagtgctcatgtaccaggggaaaagattggaaccttcctgggcctcagtcaagaaagacctgataagttatggaggcggctggaggttccaggggagctggaacaccggagaggaggtgcaagttatcgcggtggaacccggtaagaatccaaaaaacgtccagacgacacccggcacttttaagacccctgagggggaagtgggagctattgccctcgatttcaagccaggcacatccggttctcccatcgtaaatcgagaggggaaaattgtcggactgtacggcaacggcgtggttaccacttcggggacctacgtgagcgcaatcgcccaggctaaggcctcacaagaaggacctcttccggagatagaggacgaagtctttaaaaagcggaatctgacaatcatggatttgcatccaggttccggcaaaacgcgcagatatctacccgcaattgtgagggaggctatcaagcggaagctgcgaactctcattttagcccctaccagagttgtggcgagtgaaatggccgaggcactgaaagggatgccaatccgctaccagacaaccgctgtcaagtctgaaactacaggaagggagatagtggaccttatgtgccacgccaccttcacgatgcgtctgctcagccccgtacgggtgcctaactataatatgattatcatggatgaggctcattttactgacccggcatccatcgccgccagaggctacatttcaacaagggttggtatgggggaagctgcggcaatcttcatgaccgccacccccccaggatctgtcgaggcttttcctcagagcaacgccgtgatacaggatgaagagcgcgacattcccgaacgaagttggaattccggctatgattggatcactgacttcccaggcaaaacagtgtggtttgtccctagcattaagtctgggaacgatatcgcaaattgtttgagaaaaaacggaaagcgggtaatacaactgtcaaggaagaccttcgacacagagtaccagaaaactaagaacaatgactgggattatgtggttacgaccgacatttccgagatgggtgccaacttccgcgctgatcgtgtgatcgaccccagacggtgcctcaaaccagtcatcctgaaggatggcccggaaagggtgattcttgcggggcctatgcccgttacagtggccagtgcagctcagcgccgaggaagaatcggccggaatcagaacaaagagggtgaccaatacgtctacatggggcagccactaaataacgatgaagaccacgcccattggactgaggcaaagatgctgttggataatattaacacccccgagggcataatccctgccttatttgaaccagagagggaaaagagcgctgccattgacggagagtatcgcctgagaggcgaagcgaggaaaacattcgtggagctcatgcggcgtggggatctgcccgtatggctttcgtacaaggtggcatctgagggatttcagtattccgaccgccgatggtgcttcgatggtgaaagaaataaccaggttctggaggaaaatatggacgtcgagatctggaccaaagaaggcgagaggaagaaactccggcctcgctggttggacgccagaacttacagcgatccgctggctctaagggagtttaaggaattcgccgctgggcggcgatcagtgagtggagacctgatcctcgagattggcaaacttccacaacacctgacgttaagagcacagaacgccttggataatctggtgatgctccacaactctgaacagggtgggaaggcttatcgccatgccatggaggaactgcccgacaccatagagacacttatgctgctcgcattgatcgcggtcctgactggcggagttaccttatttttcctatccggcaaggggctgggaaaaacaagcattggtctcctttgtgtgaccgcctcaagtgctctgttgtggatggccagcgtagagcctcactggatcgcagcttccattatcctggaatttttcctcatggtgctgcttatacccgagccagataggcagcggactcctcaagacaatcagctcgcctacgtcgtgatcggcctgttgtttatgattctgacagttgcagccaacgaaatggggttactagagacgaccaagaaagatctgggaatcggctatgtggctgcggagaaccatcagcacgccactatgctcgacgtcgatcttcgtcccgcatctgcttggacactgtacgccgtagccaccaccgtgattacaccaatgatgagacacactatcgaaaatacgaccgcaaacataagcttgacagctattgccaatcaagcggctatcctgatgggtctcgacaaggggtggcctatttccaaaatggatatcggcgttccgctgcttgccttaggatgctactcacaggtgaaccccctgactctcaccgcagccgtcttgatgctggtggctcattatgcaataatcggcccagggctacaggccaaggcgacaagggaggctcagaagcgcaccgccgcaggaattatgaaaaatcctactgtcgacggcatcgtggccattgatctggaccccgttgtgtacgacgctaagttcgaaaaacaactcggtcagatcatgcttctgatattgtgtacgtctcagattctgctcatgcggacaacctgggccctgtgcgagagtatcactttagcaaccgggccacttacaactctgtgggaaggatcgcctggcaagttttggaacaccacaatcgctgtaagcatggccaatattttccgaggttcctatctcgcgggcgccgggctagcattctctctgatgaaatcattgggaggcgggagaaggggaacgggcgctcagggtgagaccctgggggagaagtggaagcgccaactcaaccagcttagcaaatccgaatttaatacttacaagcggagtggaatcatggaggtggatagatctgaagccaaagagggcctgaagcgtggtgaaacaaccaaacacgcagtcagcaggggcactgctaagttgcggtggttcgttgagcgcaacctggtgaagcccgaggggaaagtcatagacctcggatgtggccgagggggatggtcatattactgcgccggcttaaagagagtgacagaagtaaaaggttataccaaggggggaccgggccatgaggaaccaattcctatggccacgtacggctggaatctggtgaaacttcactccgggaaggatgtttttttcatgcccccagagaaatgtgacaccctgctatgcgatatcggagaaagtagccccaaccctacaattgaggagggtaggactctccgggtgctgaagatggtcgaaccgtggttgaagggcaatcagttttgtatcaaaatactgaacccctacatgccatctgtggtcgagaccctcgaacagatgcaacgcaagcatgggggaatgcttgtgagaaatcctctgtccaggaactcaacacacgagatgtattgggttagctgcggcactggtaatatcgtatcggcggtgaacatgacctctcgaatgttactgaaccggttcacaatggctcaccgtaaacccacctacgagagagacgtcgatttgggggcaggaactcgccatgtggccgttgaacctgaggtggctaatctcgacattatcggccagaggattgaaaacatcaagaatgagcacaaaagtacgtggcattatgatgaagacaacccatacaagacatgggcctatcacggctcctacgaggtcaagcccagcgggtcagcatcctctatggtgaatggagtagtgcggctgctaaccaaaccttgggatgttattccaatggtcactcagatcgccatgaccgacacaacgccctttggtcaacagagagtgttcaaggagaaagtggacacccgcactccgagggctaagcgaggcacaacccagataatggaagtcactgcgaaatggctttgggggtttctgagccggaacaagaagcctagaatttgtacaagggaggaattcacccgcaaagttcgtagtaatgccgcaatcggagctgtgtttgtagatgagaaccagtggaattccgccaaggaagcagtggaggacgagcggttctgggatctcgtccacagagaaagggagctgcataaacaaggcaagtgcgccacatgcgtgtataacatgatgggtaaacgcgaaaagaagttgggggagtttggaaaagctaagggcagccgagccatctggtacatgtggctgggcgcgcggttcctcgaattcgaggcacttgggtttatgaatgaggaccactggttctctagagaaaactcactgagtggagttgagggtgaaggcttacataaactggggtacattttgagggatatatccaagatcccaggaggcaatatgtatgccgacgatactgctggttgggacacccgcattacggaggatgacctccagaacgaggccaaaatcaccgatattatggaacccgagcacgcactgctagctacaagcatctttaagcttacttaccagaataaagtggtcagagtgcagcggcctgccaagaacgggaccgtaatggacgttatatctaggcgtgatcaacgaggatcgggccaggtgggcacatatgggctgaacactttcaccaatatggaagtccagctcatccgccagatggagtcagaaggaatttttctgccaagcgagttggagacgcccaacttagctgaaagagtgctggactggctcgagaagcatggtgccgaacggcttaaaaggatggcaatctccggcgacgattgtgtggtcaagccgattgacgatcgcttcgcgacagccctgaccgctctaaatgacatggggaaagttagaaaggatatccctcaatgggagcccagtaaaggatggaacgactggcagcaggtgccattttgctctcaccacttccatcagctgataatgaaggatggccgggaaattgtagtgccttgtaggaatcaagacgagctcgtcggtcgagcccgtgtgagccagggggcaggatggtccttgagagagactgcttgcctgggcaagtcatacgcccagatgtggcaacttatgtattttcaccgccgggatctgaggctcgcagccaacgcgatctgtagtgctgttcccgtggactgggtcccaacatctagaaccacttggagcatccatgcccaccaccagtggatgaccacagaagatatgttatccgtgtggaatcgcgtatggattgaggaaaacccctggatggaggacaaaacgcatgtttcaagctgggaagaggtgccttacctgggcaagcgggaggaccagtggtgcgggtctttgataggactgaccgcaagggccacttgggctacaaatatccaggtcgccattaaccaagtgcgaagactcatcggtaatgaaaactatcttgattacatgacctccatgaaacggttcaagaatgagagtgacccagaaggcgcactgtggtga

SEQ ID NO: 13237 - RNA, 9879 nt, synthetic construct
  misc_feature 1..9879: note = derived and/or modified CDS sequence (opt3) from DENV-1__GU131863__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagttggtgtgaacatgtgcacactcattgcaatggacctgggcgagctttgtgaagatactatgacctacaaatgcccacggataacagaggccgaaccggacgatgtagactgttggtgcaatgcgaccgatacttgggtgacatatgggacctgtagtcaaacgggagagcaccgccgagacaagcgtagcgtcgctctggccccccatgtgggcttgggtctcgagactagaaccgaaacatggatgtcctctgagggggcatggaaacagatccagaaggttgaaacttgggccctgaggcaccctggattcaccgtgattgctctgtttctcgcacatgccatcggcacatcgattacccagaagggcatcatattcatcttactgatgcttgtcacgccatcaatggctatgcggtgcgtggggattggaaaccgcgattttgtagagggtttgagcggcgccacttgggttgacgtggtcctggagcacgggagttgtgtgacaaccatggcgaaaaataagcccactctagatatcgaactcctgaaaacagaggtgaccaaccctgcagtccttagaaagctgtgcattgaagccaaaatctccaatacgaccacagactctaggtgtccaactcaaggagaggctaccttggttgaagagcaggatgccaacttcgtgtgccggcgcacatttgtagaccgaggctggggtaatgggtgtggactcttcggcaagggcagcctgttaacttgcgcaaagtttaaatgcgtgaccaagctggaggggaaaatagtccagtacgaaaacctcaagtattccgtgattgttacagtgcacaccggagatcagcatcaagtcggtaatgagactacggaacacggcacaatcgctaccattactccccaggcccctacctcagagatccagcttacagactacggggcgctgaccttggactgtagtccaagaactggactagatttcaacgaaatggtgctgctcacaatgaaagagaagagctggctggtacataaacagtggtttcttgacctgccgttgccctggacgtctggcgcctccacctcacaagagacttggaataggcaggatctcctggttacattcaagaccgcacacgctaagaaacaggaagtggtcgtgttaggtagccaagagggggccatgcacacagctctgactggcgccaccgaaatccagacgagtggaaccacaactatttttgcaggccatctaaagtgccggctcaaaatggacaagctgacccttaaagggatgtcttatgtcatgtgtacaggatccttcaagttggagaaggaagtggccgagactcagcacggtaccgttctggtgcaggtaaaatacgagggcacggatgctccttgcaagataccattcctcacacaagacgaaaaaggggtcacccagaacggacgtctgatcactgcgaatcccattgtgacagataaggagaaacctgttaacatcgaaaccgagccaccctttggcgagagctatatagtggtcggtgcaggggaaaaggcccttaagctgtcgtggttcaaaaagggctcttccattggaaaaatgtttgaggctactgcccgcggcgcaagaaggatggccatcttgggggacaccgcttgggatttcggatcaatcggtggcctctttacaagtgtggggaagctgattcatcaggtattcggaacggcctacggcgtgttatttagcggtgtttcctggaccatgaaaatcgggattggcatactgctaacttggctcggactgaattctcggagcacatcacttagtatgacctgtatcgcagtcggcatggtgacattgtacctgggggtgatggtccaggcggactccggatgcgttattaactggaagggccgagaactcaagtgtggtagcgggatcttcgtgactaacgaggtgcacacctggacggaacaatataaatttcaggctgattctccgaagcgcctgtcagccgcaatcggaaaagcctgggaggagggcgtatgcggtattagaagtgctacaaggttagaaaatataatgtggaagcagatcagcaacgagctgaattacattcttttggaaaacgacatgaaattcaccgtcgtggttggcgacatcaatgggattctcgcccagggaaagaaaatgatccggcctcaacccatggagcataagtattcctggaagtcttggggcaaagcaaagataatcggggctgatattcagaacactacctttatcattgacggaccagatacacctgaatgtcccgacgatcagcgcgcctggaatatctgggaggtggaggactacggcttcggtatatttactaccaacatttggctgaaactaagagattcgcacacacagatgtgcgaccacaggctgatgagcgcggccatcaaggattccaaagctgtccatgcagacatggggtattggattgaatcagagaagaatgaaacgtggaagctcgcccgtgctagtttcatcgaggtgaaaacctgtatatggccaaagtctcacactctgtggagcaacggagttcttgaatccgagatggtgatccccaaaatttacggcggtcctatctcacaacataattatcggccaggctacttcacacagaccgccgggccgtggcacttgggaaagctggagttagattttgacctctgcgaaggcactacagtagtcgtggatgagcactgcgggtaccgaggacccagcctgagaaccacgactgtgaccggcaaaattatccatgaatggtgttgcaggtcttgtacacttcctccactgcgcttccggggtgaggacgggtgctggtatggaatggagataagacccgtcaaggaaaaggaggaaaacttggttaggtccatggtgagtgcaggcagcggtgaggtagactctttttccctcggcattctgtgtgtgtcaatcctaatcgaagaggtcatgcgcagtcgatggagccggaaaatgctgatgaccgggactctcgcggtgttcctgcttttgattatgggacagctgacatggaatgatttaatccgtctctgcattatggttggcgccaacgcttcggacagaatggggatgggaaccacatacctggcccttatggcaacttttaagatgaggcctatgttcgctgtgggcctgctatttcgccggctcacctccagagaggtcctgttgctgacggtgggtttatctctcgttgccagcgtggaactgccaaattcacttgaggaactgggggatggattggcaatgggcataatgatgctcaaactgctaacagacttccaaccccaccagctgtggaccactcttctcagtctgacctttatcaggacatccttgtctctggattatgcctggaagactatggctatggcgttaagcattgtctccctcttcccgctgtgtctttcaaccacgagccagaaaacaacctggctgcctgtattgctcggcagttttgggtgcaagccactgactatgttcctaatcacagagaacaagatttggggacgaaaatcttggcccatcaacgaaggtataatggccgtgggcatcgtttccattctgcttagctcgctcctgaagaatgacgtgcctttggcagggcccttaatcgctggaggcatgctgattgcctgttacgtcatctcaggttctagtgccgatctctccctggagaaagctgcagaggtgagctgggaagaggaagccgagcattctgggaccagccacaacatacttgtagaagtgcaggacgatggaactatgaagattaaagacgaggagcgcgatgacacactgaccatcttgctaaaggcgacgctgctcgctgtctccggcgtttatccaatgtcaatccctgccactctgtttgtgtggtacttctggcaaaaaaagaagcagcggagtggcgtgctttgggatacccccagcccaccggaagtcgagagagcagtgttagacgacgggatttataggatactgcagcgtggactcttgggtcgctctcaggttggcgtaggggtgttccaagatggagtctttcatacaatgtggcacgtgacccggggcgccgttctgatgtaccagggtaaaagactcgaaccttcctgggcttcagtgaagaaagacctgatcagttacgggggaggctggaggttccagggcagctggaatacaggggaggaggtccaggtgattgcagtagaacccggaaagaacccaaaaaatgtccaaactacccccggtacgtttaagacacctgagggcgaagtgggggccatcgcgcttgatttcaagccaggaacttccggctctcccattgttaaccgagagggtaaaatcgtggggctgtatggaaatggcgtcgtgaccacatcgggcacctacgttagcgctatagcccaggcaaaggccactcaggaagggcctttgccggagatcgaggacgaagtgtttaaaaagcggaacctaaccattatggatctgcacccaggatcaggtaaaacacgcagatatctccccgctatcgtcagggaggccattaagcggaagttacgaacgctgatccttgcacctactagagtggtagcttccgaaatggccgaggcgctgaaaggcatgccaatacgctaccaaaccacagccgtgaagagtgaacataccgggagggagattgttgacctcatgtgccacgcaactttcacaatgcgtttgctgtctcccgtccgggtgcctaattataacatgatcatcatggatgaggctcattttaccgacccggccagcattgctgcaagaggatacatctccacgagggtgggcatgggtgaagccgccgctatattcatgactgcgacacccccagggtcagtcgaggcatttcctcagtctaatgccgtaattcaggatgaagagcgcgacatccccgaacgaagctggaacagtggatatgattggattaccgacttcccaggcaaaaccgtgtggtttgttccttccatcaagagcggcaatgacatagctaactgtctcagaaaaaatgggaagcgggtgattcagctgtctaggaagactttcgatacagagtaccaaaaaaccaagaacaacgactgggattacgtcgtgacaactgacatctcagagatgggagccaatttccgcgcagatcgtgttatcgaccccagacggtgccttaaaccagtgattctaaaggaaggtccggagagggtcatcctggccggccctatgcccgtgacggtagcttccgcggcccagcgccgagggagaattggacggaaccagaataaagaaggcgatcagtatatatacatgggtcaaccattgaacaatgacgaggatcacgcacattggaccgaggctaagatgttactggacaacatcaatacacccgaagggattatccctgccctctttgagccagaaagggagaagagtgcagccatcgatggcgaatatcgcctgagaggagaggctaggaaaactttcgtggagcttatgcggcgtggcgacctgcccgtttggctcagctacaaggtcgcctcggaagggtttcagtattctgatcgccgatggtgcttcgacggagagagaaacaatcaggtgttggaagagaacatggacgtggaaatttggaccaaagagggtgagaggaagaaactgcggcctcgctggctagatgcgagaacatactccgacccgctggcactcagggaatttaaggagttcgccgctggccggcgaagcgtctcaggggatcttatactggaaatcggaaaattaccacagcacttgaccctgagagcccaaaatgctctcgacaacctggttatgcttcacaatagtgagcagggcggtaaggcatatcgccatgccatggaagagctgcccgatactattgagacgctcatgttgctggctttaatcgccgtgctaaccgggggcgtaacactgtttttcctctctggaaagggccttgggaaaacttccattggactgttgtgtgtgatggcaagctcagcgctgctctggatggccagtgtcgaacctcactggatcgctgccagcataatcctggagtttttccttatggtgctcctgattcccgaaccagacaggcagcggacccctcaggataaccaattggcatacgttgtgatcggtctgttatttatgattctaacagtcgctgccaatgagatgggcctgctcgagaccactaagaaagaccttgggatcggacatgtagcagtggaaaaccaccaccatgccacaatgctggatgttgacttgcgtcccgcttccgcgtggacgctgtacgccgtggcaaccactgtcataacaccaatgatgagacacaccattgagaacaccacagctaatatctctctcactgccattgccaaccaggcagctatcctgatgggccttgataagggttggcctataagcaaaatggacatcggggtgccgttactggccctcggctgctattcccaggtcaatcccttgacgctgaccgcggctgtgctaatgctggttgcccattacgcaattatcggaccaggcctccaagccaaggctacaagggaagcacagaagcgcactgccgcggggattatgaaaaaccctaccgtggatggaatcgtaacaatagaccttgaccccgtggtctatgatgctaagttcgagaaacagctgggccagattatgttgctgatcctctgtacctcacaaatcctgttaatgcggactacgtgggccctttgcgaatctattacactggcaaccggtccactcactaccctatgggaggggagtcctggaaagttttggaatacaactatcgccgtttcgatggctaacatattccgaggcagctacctggccggtgcaggcttggctttctccctgatgaaatctctcgggggaggcagaagggggaccggagcccagggcgagacacttggtgaaaagtggaagcgccagctgaatcagttgtcaaaaagcgagtttaacacgtataagaaatccgggattatggaagtggaccggagtgaggcgaaggaaggactgaaaagaggcgagaccactaagcacgccgtctctcgtggtacagcaaagctcaggtggttcgtggagcggaatttagtaaaacccgaaggcaaggtgatcgatctggggtgtggacgcggcgggtggagctactattgcgctggacttaaaaaggttaccgaggtgaaaggctacactaagggtgggccgggacatgaagagccaattcctatggccacatacggctggaacctggtcaaactacactcaggcaaggacgtgtttttcacccccccagaaaagtgtgatacgctcctgtgcgacatcggggagtccagtcccaatcctaccatagaggaaggacgaacattgagagtcctgaaaatggtggagccgtggctcaggggtaaccaattttgtatcaagattcttaatccctatatgccaagcgttgtagaaactctggagcagatgcagcggaaacacggcgggatgttagtgcgcaaccctctgtctagaaattccacccatgagatgtactgggtctcatgcggaacaggcaacatcgtgagcgcagttaatatgacttcgaggatgttgctcaaccgattcaccatggctcaccggaagcccacatatgaacgtgatgtggacctgggtgccgggaccagacatgtcgccgtggagcctgaagtagcgaacctagatattatcggacagcgcattgagaatatcaaaaacgaacacaagtctacttggcactacgacgaggataatccatataagacgtgggcttaccatggcagttatgaggtgaaaccctccggcagcgcatcatccatggttaacggggtcgtgaggcttctgacaaagccttgggacgtgataccaatggtcacccaaattgccatgactgacaccacaccctttggacagcagcgggttttcaaagaaaaggtggatacgagaaccccgcgcgctaaaaggggtactgcccaaatcatggaggtaacagcaaagtggctctggggctttctgtctcgaaataagaaacctcggatctgtaccagagaagagttcactaggaaggtgcgcagcaacgccgctattggggcggtctttgtggacgaaaatcagtggaacagtgccaaagaggcagttgaggatgaacgtttctgggacttggtgcaccgggagagagaactgcataagcagggaaaatgcgctacatgcgtctacaatatgatgggcaagagggagaagaaactcggtgaatttgggaaggccaaaggatcccgcgcaatatggtacatgtggcttggcgcccgattcctggagttcgaggctttaggctttatgaacgaagatcactggttcagccgggagaattctctgtcaggggtggaaggagagggtttgcataagctcggctatatcctgagagacattagtaaaatcccagggggaaacatgtacgccgatgacaccgcgggctgggatacaaggattactgaggacgatctacagaatgaagcaaagatcaccgacataatggagcccgaacacgcccttctggctacgtccatctttaaactcacctatcaaaacaaggtagttcgcgtgcagagacctgccaagagcggtacagtcatggatgtgatttctcggagggaccagcgtgggtcgggacaggtgggcacttacggcctgaataccttcacaaacatggaggtccaattgatccgacagatggaatcagaggggatttttagcccatccgagttagaaactcccaacctggcaaaaaaggttctcgactggcttgagaaacacggagctgaacgcctgaagagaatggccatcagtggtgatgactgtgtggtaaaaccgatagatgaccggttcgctaccgccctaacggcactgaatgatatgggcaaggtgaggaaggacattcctcagtgggagccctctaaagggtggaacgattggcagcaagtcccattttgcagccatcacttccatcagctcatcatgaaggacggacgcgaaatcgtggttccttgtagaaatcaggatgagttggtgggccgggcgagggtctcccagggtgccgggtggtcactgcgagagacagcttgccttggaaaaagttatgcccaaatgtggcagctgatgtactttcaccgtagagacctccgcttagcagctaacgccatttgttctgcagtgcccgtagattgggttccaaccagccggactacatggtccatacacgcccatcaccagtggatgaccactgaagacatgctgtcagtgtggaatagggtctggatcgaggaaaacccctggatggaggacaagacccatgtgagctcttgggaagaggttccttatttgggcaaaagagaggatcaatggtgcggctccctgattgggctcacagcgcgcgctacgtgggccaccaatatccaggtggcaattaaccaggtccggaggcttatcggaaatgaaaactacctggactacatgactagtatgaagcgattcaagaatgagagcgatccagaaggtgccctatggtga

SEQ ID NO: 13238 - RNA, 9879 nt, synthetic construct
  misc_feature 1..9879: note = derived and/or modified CDS sequence (opt3) from DENV-1__GQ868559__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaaacagatccagagggtggaaacttgggctctgcggcaccctggattcaccgttattgcactgtttctcgcccatgctatcggcacatcgattacccagaagggcatcatattcatcttactgatgcttgtgacgccatcaatggccatgcgctgcgtcgggattggaaacagagattttgtggagggtttgagcggcgcgacttgggtagacgttgtgctggagcacgggagttgtgtcacaaccatggcaaagaataaacccactctagatatcgaactcctgaagacagaggtgaccaaccctgccgtgcttaggaaactgtgcattgaagctaagatctccaatacgaccacagactctcggtgtccaactcaaggagaggccaccttggtcgaagagcaggatgcaaacttcgtttgccgccgaacatttgtggacagaggctggggtaatgggtgtggactcttcggcaaaggcagcctgttaacttgcgctaagtttaagtgcgtaaccaaactggaggggaagatagtgcagtacgaaaacctcaaatattccgtcattgtgacagttcacaccggagatcagcatcaagtgggtaatgagactacggaacacggcacaatcgccaccattactccccaggcgcctacctcagagatccagcttacagactacggggccctgaccttggactgtagtccaaggactggactagatttcaacgaaatggtcctgctcacaatgaaggagaaaagctggctggtgcataagcagtggtttcttgacctgccgttgccctggacgtctggcgcatccacctcacaagagacttggaatcggcaggatctcctggtaacattcaaaaccgctcacgccaagaagcaggaagttgtggtcttaggtagccaagagggggctatgcacacagccctgactggcgcaaccgaaatccagacgagtggaaccacaactatttttgccggccatctaaaatgccgtctcaagatggacaaactgacccttaaggggatgtcttatgtgatgtgtacaggatccttcaaattggagaaggaagtcgctgagactcagcacggtaccgtgctggttcaggtgaagtacgagggcacggatgcgccttgcaaaataccattcagcacacaagacgaaaagggggtaacccagaacggacgcctcatcactgcaaatcccattgtcacagataaagagaagcctgtgaacatcgaaaccgagccaccctttggcgagtcgtatatagttgtgggtgccggggaaaaagctctgaagctttcttggttcaagaaaggctcctcaattggaaagatgtttgaggccactgcaagaggcgccaggcggatggctatcctgggggacaccgcctgggatttcggaagtatcggtggcgtctttacaagcgtggggaaattggtacatcaggtgttcggaacggcatacggcgttctcttttccggtgtctcttggaccatgaagattgggatcggcattctgttaacttggctgggactaaatagccgatcaacaagtctctccatgacctgtatagcggtgggcatggtgacactgtaccttggggtcatggttcaggctgacagcggatgcgtgatcaactggaaaggccgcgaattgaagtgtggttctgggattttcgtgactaacgaggtacacacctggacggaacaatataagtttcaggccgattcaccgaaaagactgagtgcagccatcggaaaggcttgggaggagggcgtctgcggtatcaggagcgccacacggctcgaaaatattatgtggaaacagatatccaacgagctgaatcatatcttactggaaaacgacatgaagttcaccgtggttgtgggcgacgcaaatgggattcttgctcagggaaaaaagatgatccgccctcaacccatggagcacaaatactcttggaagtcgtggggcaaggccaaaattatcggggcggatatacagaacactacctttatcattgacggaccagatacacctgaatgtcccgacggccagagagcctggaatatctgggaggtcgaggattatggtttcgggatttttactaccaacatctggttgaagctcagggacagctacacacagatgtgcgatcaccgtctgatgtccgctgcaataaaagactcaaaggccgtgcatgctgatatgggatattggattgaaagtgagaaaaatgaaacgtggaagctagcccgggcatctttcatcgaggttaagacctgtacttggccaaaaagccacacactgtggtccaacggcgtgctcgaatcagagatgattatccccaagatatacggtggccctatcagccaacataattatcgaccagggtacttcacccagactgcgggaccgtggcacctgggcaaacttgagttggactttgatctgtgcgaagggacaaccgtagtcgtggacgagcactgcggaaacagaggcccctctttaaggacgactaccgtgacaggtaagattatccatgaatggtgttgccgctcctgtaccctccctccactgcggttcagaggggaggatggatgctggtacggcatggagattaggcccgtcaaagaaaaggaggaaaatcttgttcgcagtatggtgagcgccggttctggcgaggtagactccttttcactggggatcttgtgtgtgagtataatgattgaagaggtcatgcgaagccggtggtcgcgtaagatgctcatgactggaacactggctgtgttcctactgctcatcatgggccagctgacctggaacgaccttatcagattgtgcattatggttggggccaatgcatccgataggatgggaatgggcacaacttatctggctttaatggccacctttaaaatgcgccctatgttcgcagtgggtctcctgtttcggagacttacgtctagggaggtcctgctactcacaatcgggctgagcttggtggcctcagttgaactgccaaacagtttagaggaactcggagacggcctggctatgggcattatgatgcttaagctgttgaccgagttccaaccccaccagctctggactaccctgctatccctgacatttgtgaaaactaccctttctctcgattacgcgtggaagacgacagccatggtcctgagcatagtatccttgttcccgctgtgtttatcaaccactagccagaaaacaacctggctccctgtgctgcttgggagttttggatgcaagccactgactatgttcttgatcacagaaaacaagatttggggtcgaaaatcttggcccctcaatgagggcatcatggcaattgggatcgtttccatactgctaagctcgctgcttaagaacgacgtgcctctcgctggacccctgatcgccggcggtatgttgattgcctgttatgtcatctcagggtctagtgctgatttatccctggagaaagcagccgaagtgagctgggagcaggaagcggagcattctggagctagccacaatattctcgtagaagtgcaagacgatggcaccatgaagatcaaagacgaggagcgcgatgacacgctgactatacttctgaaggccaccttgctagcagtctccggcgtttacccaatgtcaattcctgccacactgtttgtgtggtatttctggcagaaaaagaagcagcggagtggggtgctctgggatacccccagcccaccggaagtcgagagagctgtgctggacgatggaatctacaggatccttcagcgtggtttactgggccgctctcaagttggggtaggagtgttccaggacggcgtctttcatacaatgtggcacgtgactcggggtgcagttctcatgtatcaggggaaaagattggaaccttcctgggcctcagtgaagaaagacctgattagttacggaggcggctggaggttccaggggagctggaacaccggagaggaggtccaagtgatagcggtagaacccggtaagaatccaaaaaacgtccagacgacacccggcacttttaagacccctgagggggaagtgggagctatcgccctcgatttcaagccaggcacatccggttctcccattgttaatcgagaggggaaaatcgtgggactgtacggcaacggcgtcgtgaccacttcggggacctatgttagcgcaattgcccaggctaaggcctcacaagaaggacctcttccggagatcgaggacgaagtgtttaaaaagcggaatctgacaataatggatttgcacccaggttccggcaaaacgcgcagatacctacccgcaatcgtcagggaggctattaagcggaagctgcgaactctcatcttagcccctaccagagtggtagcgagtgaaatggccgaggcactgaaagggatgccaattcgctatcagacaaccgctgtgaagtctgaacatactggaagggagatcgttgaccttatgtgccacgccacattcaccatgcgtctgctcagccccgtccgggtgcctaactacaatatgataattatggatgaggctcattttacggacccggcatccatcgccgccagaggctatatctcaactagggtgggtatgggggaagctgcggcaattttcatgacagccacccccccaggatctgtcgaggcttttcctcagagcaacgccgtaatccaggatgaagagcgcgacatacccgaacgaagttggaattccggctacgattggattaccgacttcccaggcaaaactgtgtggtttgttcctagcatcaagtctgggaacgatattgcaaattgtttgagaaaaaacggaaagcgggtgatccaactgtcaaggaagacattcgacaccgagtatcagaaaacaaagaacaatgactgggattacgtcgtgactacggacatatccgagatgggtgccaacttccgcgctgatcgtgttattgaccccagacggtgcctcaaaccagtgatcctgaaggatggcccggaaagggtcatccttgcggggcctatgcccgtgaccgtagccagtgcagctcagcgccgaggaagaattggccggaatcagaacaaagagggtgaccaatacgtgtatatggggcagccactaaataacgatgaagaccacgcccattggacagaggcaaagatgctgttggataatatcaacactcccgagggcattatacctgccttatttgaaccagagagggaaaagagcgctgccatcgacggagagtaccgcctgagaggcgaagcgaggaaaaccttcgttgagctcatgcggcgtggggatctgcccgtctggctttcgtataaggtggcatctgagggatttcagtactccgaccgccgatggtgcttcgatggtgaaagaaataaccaggtgctggaggaaaatatggacgtcgagatttggacaaaagaaggcgagaggaagaaactccggcctcgctggttggacgccagaacctatagcgatccgctggctctaagggagtttaaggaattcgccgctgggcggcgatcagttagtggagacctgatcctcgagatcggcaaacttccacaacacctgactttaagagcacagaacgccttggataatctggtgatgctccacaactctgaacagggtgggaaggcttaccgccatgccatggaggaactgcccgacacgattgagacccttatgctgctcgcattgatagcggtactgacaggcggagtgactttatttttcctatccggcaaggggctgggaaaaaccagcatcggtctcctttgtgtcacagcctcaagtgctctgttgtggatggccagcgtggagcctcactggattgcagcttccatcattctggaatttttcctcatggttctgcttatccccgagccagataggcagcggacccctcaagacaatcagctcgcctatgtggtcataggcctgttgtttatgatcctgactgtagcagccaacgaaatggggttactagagacaacgaagaaagatctgggaattggctacgtggctgcggagaaccatcagcacgccaccatgctcgacgttgatcttcgtcccgcatctgcttggactctgtacgccgtggccacaaccgtcatcaccccaatgatgagacacacaattgaaaatactacggcaaacatcagcttgaccgctatagccaatcaagcggctattctgatgggtctcgacaaggggtggcctatctccaaaatggatattggcgtgccgctgcttgccttaggatgctattcacaggtcaaccccctgacactcactgcagccgtgttgatgctggttgctcattacgcaatcataggcccagggctacaggccaaggcgaccagggaggctcagaagcgcacagccgcaggaatcatgaaaaatcctaccgtggacggcattgtagccatcgatctggaccccgtggtctatgacgctaagttcgaaaaacaactcggtcagattatgcttctgatcttgtgtacttctcagatactgctcatgcggacgacatgggccctgtgcgagagtattaccttagcaactgggccacttaccacactgtgggaaggatcgcctggcaagttttggaacactaccatcgctgttagcatggccaatatcttccgaggttcctacctcgcgggcgccgggctagcattctctctgatgaaatcattgggaggcgggagaaggggaacaggcgctcagggtgagacgctgggggagaagtggaagcgccaactcaaccagcttagcaaatccgaatttaatacctataagcggagtggaattatggaggtggatagatctgaagccaaagagggcctgaagcgtggtgaaactacaaaacacgcagtcagcaggggcaccgctaagttgcggtggttcgtggagcgcaacctggtaaagcccgaggggaaagtgatcgacctcggatgtggccgagggggatggtcatactattgcgccggcttaaagaaagttactgaagtgaagggttacacaaaagggggaccgggccatgaggaaccaatacctatggccacctacggctggaatctggtcaagcttcactccgggaaagatgtgtttttcatgcccccagagaagtgtgacacgctgctatgcgatattggagaaagtagccccaaccctaccatcgaggagggtagaacactcagggtcctgaagatggtggaaccgtggttgcggggcaatcagttttgtattaaaatcctgaacccctatatgccatctgttgtagagactctcgaacagatgcaacgcaagcatgggggaatgcttgtgagaaatcctctgtccaggaactcaacccacgagatgtactgggtcagctgcggcacaggtaatatagtgtcggcggttaacatgacttctcgaatgttactgaaccggttcaccatggctcaccgtaaacccacatatgagagagacgtggatttgggggcaggaacccgccatgtcgccgtggaacctgaggaagctaatctcgacatcattggccagaggatcgagaacattaagaatgaacacaaaagtacttggcattacgatgaggacaacccatataagacgtgggcctaccacggctcctatgaggtaaagcccagcgggtcagcatcctctatggtgaatggagttgtccggctgctaacaaaaccttgggatgtgatcccaatggtgacccagattgccatgactgacaccacaccctttggtcaacagagagtcttcaaggaaaaagttgacacgcgcaccccgagggctaagcgaggcactacacagatcatggaggtgaccgcgaaatggctttgggggtttctgagccggaacaagaagcctagaatatgtactagggaagagttcacacgcaaagtacgtagtaatgccgcaattggagctgtgtttgtcgatgaaaaccagtggaattccgccaaggaggcagtggaggacgaacggttctgggatctcgttcacagagagagggaactgcataaacaaggcaagtgcgccacctgcgtgtacaacatgatgggtaaacgcgagaagaagttgggggaatttggaaaagctaagggcagccgagccatctggtacatgtggctgggcgcgcggttcctcgagttcgaggcacttgggtttatgaatgaagaccactggttctctagagagaactcactgagtggagtcgaaggtgagggcttacataaactggggtatatcttgagggatatttccaagataccaggaggcaatatgtacgccgacgatacagctggttgggacactcgcatcaccgaggatgacctccagaacgaagccaaaattacggatatcatggagcccgaacacgcactgctagctaccagcatttttaagcttacatatcagaataaagtggtaagagttcagcggcctgccaagaacgggactgtgatggacgtcatctctaggcgtgatcaacgaggatcgggccaggtgggcacctacgggctgaacacattcactaatatggaggtgcagctcatacgccagatggaatcagagggaatctttctgccaagcgagttggaaacccccaacttagctgagagagtcctggactggctcgaaaagcatggtgccgagcggcttaaaaggatggcaatttccggcgacgattgtgttgtgaagccgatcgacgatcgcttcgcgacggccctgacagctctaaatgacatggggaaagtaagaaaggatattcctcaatgggaacccagtaaaggatggaacgactggcagcaggtgccattttgctctcaccacttccatcagctgatcatgaaggatggccgggagatagtcgtgccttgtaggaatcaagacgagctcgttggtcgagcccgtgtgagccagggggcaggatggtccttgagagaaaccgcttgcctgggcaagtcatatgcccagatgtggcaacttatgtactttcaccgccgggatctgaggctcgcagccaacgcgatttgtagtgctgtccccgtggactgggtaccaacttctagaacaacctggagcatccatgcccaccaccagtggatgactaccgaggatatgttatccgtttggaatcgcgtgtggatcgaagagaacccctggatggaagacaaaacacatgtctcaagctgggaggaggtgccttatctgggcaagcgggaagaccagtggtgcgggtctttgattggactgacggcaagggccacctgggctactaatatacaggttgccatcaaccaagtgcgaagactcattggtaatgagaactaccttgattacatgacatccatgaaacggttcaagaatgaaagtgacccagagggcgcactgtggtga

SEQ ID NO: 13239 - RNA, 9879 nt, synthetic construct
  misc_feature 1..9879: note = derived and/or modified CDS sequence (opt3) from DENV-1__GQ868560__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaaacagatccagagggtggaaacttgggctctgcggcaccctggattcaccgttattgcactgtttctcgcccatgctatcggcacatcgattacccagaagggcatcatattcatcttactgatgcttgtgacgccatcaatggccatgcgctgcgtcgggattggaaacagagattttgtggagggtttgagcggcgcgacttgggtagacgttgtgctggagcacgggagttgtgtcacaaccatggcaaagaataaacccactctagatatcgaactcctgaagacagaggtgaccaaccctgccgtgcttaggaaactgtgcattgaagctaagatctccaatacgaccacagactctcggtgtccaactcaaggagaggccaccttggtcgaagagcaggatgcaaacttcgtttgccgccgaacatttgtggacagaggctggggtaatgggtgtggactcttcggcaaaggcagcctgttaacttgcgctaagtttaagtgcgtaaccaaactggaggggaagatagtgcagtacgaaaacctcaaatattccgtcattgtgacagttcacaccggagatcagcatcaagtgggtaatgagactacggaacacggcacaatcgccaccattactccccaggcgcctacctcagagatccagcttacagactacggggccctgaccttggactgtagtccaaggactggactagatttcaacgaaatggtcctgctcacaatgaaggagaaaagctggctggtgcataagcagtggtttcttgacctgccgttgccctggacgtctggcgcatccacctcacaagagacttggaatcggcaggatctcctggtaacattcaaaaccgctcacgccaagaagcaggaagttgtggtcttaggtagccaagagggggctatgcacacagccctgactggcgcaaccgaaatccagacgagtggaaccacaactatttttgccggccatctaaaatgccgtctcaagatggacaaactgacccttaaggggatgtcttatgtgatgtgtacaggatccttcaaattggagaaggaagtcgctgagactcagcacggtaccgtgctggttcaggtgaagtacgagggcacggatgcgccttgcaaaataccattcagcacacaagacgaaaagggggtaacccagaacggacgcctcatcactgcaaatcccattgtcacagataaagagaagcctgtgaacatcgaaaccgagccaccctttggcgagtcgtatatagttgtgggtgccggggaaaaagctctgaagctttcttggttcaagaaaggctcctcaattggaaagatgtttgaggccactgcaagaggcgccaggcggatggctatcctgggggacaccgcctgggatttcggaagtatcggtggcgtctttacaagcgtggggaaattggtacatcaggtgttcggaacggcatacggcgttctcttttccggtgtctcttggaccatgaagattgggatcggcattctgttaacttggctgggactaaatagccgatcaacaagtctctccatgacctgtatagcggtgggcatggtgacactgtaccttggggtcatggttcaggctgacagcggatgcgtgatcaactggaaaggccgcgaattgaagtgtggttctgggattttcgtgactaacgaggtacacacctggacggaacaatataagtttcaggccgattcaccgaaaagactgagtgcagccatcggaaaggcttgggaggagggcgtctgcggtatcaggagcgccacacggctcgaaaatattatgtggaaacagatatccaacgagctgaatcatatcttactggaaaacgacatgaagttcaccgtggttgtgggcgacgcaaatgggattcttgctcagggaaaaaagatgatccgccctcaacccatggagcacaaatactcttggaagtcgtggggcaaggccaaaattatcggggcggatatacagaacactacctttatcattgacggaccagatacacctgaatgtcccgacggccagagagcctggaatatctgggaggtcgaggattatggtttcgggatttttactaccaacatctggttgaagctcagggacagctacacacagatgtgcgatcaccgtctgatgtccgctgcaataaaagactcaaaggccgtgcatgctgatatgggatattggattgaaagtgagaaaaatgaaacgtggaagctagcccgggcatctttcatcgaggttaagacctgtacttggccaaaaagccacacactgtggtccaacggcgtgctcgaatcagagatgattatccccaagatatacggtggccctatcagccaacataattatcgaccagggtacttcacccagactgcgggaccgtggcacctgggcaaacttgagttggactttgatctgtgcgaagggacaaccgtagtcgtggacgagcactgcggaaacagaggcccctctttaaggacgactaccgtgacaggtaagattatccatgaatggtgttgccgctcctgtaccctccctccactgcggttcagaggggaggatggatgctggtacggcatggagattaggcccgtcaaagaaaaggaggaaaatcttgttcgcagtatggtgagcgccggttctggcgaggtagactccttttcactggggatcttgtgtgtgagtataatgattgaagaggtcatgcgaagccggtggtcgcgtaagatgctcatgactggaacactggctgtgttcctactgctcatcatgggccagctgacctggaacgaccttatcagattgtgcattatggttggggccaatgcatccgataggatgggaatgggcacaacttatctggctttaatggccacctttaaaatgcgccctatgttcgcagtgggtctcctgtttcggagacttacgtctagggaggtcctgctactcacaatcgggctgagcttggtggcctcagttgaactgccaaacagtttagaggaactcggagacggcctggctatgggcattatgatgcttaagctgttgaccgagttccaaccccaccagctctggactaccctgctatccctgacatttgtgaaaactaccctttctctcgattacgcgtggaagacgacagccatggtcctgagcatagtatccttgttcccgctgtgtttatcaaccactagccagaaaacaacctggctccctgtgctgcttgggagttttggatgcaagccactgactatgttcttgatcacagaaaacaagatttggggtcgaaaatcttggcccctcaatgagggcatcatggcaattgggatcgtttccatactgctaagctcgctgcttaagaacgacgtgcctctcgctggacccctgatcgccggcggtatgttgattgcctgttatgtcatctcagggtctagtgctgatttatccctggagaaagcagccgaagtgagctgggagcaggaagcggagcattctggagctagccacaatattctcgtagaagtgcaagacgatggcaccatgaagatcaaagacgaggagcgcgatgacacgctgactatacttctgaaggccaccttgctagcagtctccggcgtttacccaatgtcaattcctgccacactgtttgtgtggtatttctggcagaaaaagaagcagcggagtggggtgctctgggatacccccagcccaccggaagtcgagagagctgtgctggacgatggaatctacaggatccttcagcgtggtttactgggccgctctcaagttggggtaggagtgttccaggacggcgtctttcatacaatgtggcacgtgactcggggtgcagttctcatgtatcaggggaaaagattggaaccttcctgggcctcaattaagaaagacctgataagttacggaggcggctggaggttccaggggagctggaacaccggagaggaggtgcaagtcatcgcggtggaacccggtaagaatccaaaaaacgtacagacgacacccggcacttttaagacccctgagggggaagtcggagctattgccctcgatttcaagccaggcacatccggttctcccatcgtgaatcgagaggggaaaattgttggactgtacggcaacggcgtggtcaccacttcggggacctatgtgagcgcaatcgcccaggctaaggcctcacaagaaggacctcttccggagatagaggacgaagtttttaaaaagcggaatctgacaatcatggatttgcacccaggttccggcaaaacgcgcagatacctacccgcaattgtgagggaggctatcaagcggaagctgcgaactctcattttagcccctaccagagtcgtggcgagtgaaatggccgaggcactgaaagggatgccaatccgctatcagacaaccgctgtaaagtctgaacatactggaagggagatagtggaccttatgtgccacgccacattcaccatgcgtctgctcagccccgttcgggtccctaactacaatatgattatcatggatgaggctcattttacggacccggcatccatcgccgccagaggctatatttcaactagggtgggtatgggggaagctgcggcaatcttcatgacagccacccccccaggatctgtggaggcttttcctcagagcaacgccgtcatacaggatgaagagcgcgacattcccgaacgaagttggaattccggctacgattggatcaccgacttcccaggcaaaactgtatggtttgtgcctagcattaagtctgggaacgatatcgcaaattgtttgagaaaaaacggaaagcgggttatacaactgtcaaggaagacattcgacaccgagtatcagaaaacaaagaacaatgactgggattacgtggtcactacggacatttccgagatgggtgccaacttccgcgctgatcgtgtgatcgaccccagacggtgcctcaaaccagttatcctgaaggatggcccggaaagggtgattcttgcggggcctatgcccgtcaccgtggccagtgcagctcagcgccgaggaagaatcggccggaatcagaacaaagagggtgaccaatacgtatatatggggcagccactaaataacgatgaagaccacgcccattggacagaggcaaagatgctgttggataatattaacactcccgagggcataatccctgccttatttgaaccagagagggaaaagagcgctgccattgacggagagtaccgcctgagaggcgaagcgaggaaaaccttcgtggagctcatgcggcgtggggatctgcccgtttggctttcgtataaggtcgcatctgagggatttcagtactccgaccgccgatggtgcttcgatggtgaaagaaataaccaggtgctggaggaaaatatggacgtggagatctggacaaaagaaggcgagaggaagaaactccggcctcgctggttggacgccagaacctatagcgatccgctggctctaagggagtttaaggaattcgccgctgggcggcgatcagtcagtggagacctgatcctcgagattggcaaacttccacaacacctgactttaagagcacagaacgccttggataatctggttatgctccacaactctgaacagggtgggaaggcttaccgccatgccatggaggaactgcccgacacgatagagacccttatgctgctcgcattgatcgcggtgctgacaggcggagtaactttatttttcctatccggcaaggggctgggaaaaaccagcattggtctcctttgtgtgacagcctcaagtgctctgttgtggatggccagcgtcgagcctcactggatcgcagcttccattatcctggaatttttcctcatggtgctgcttatacccgagccagataggcagcggacccctcaagacaatcagctcgcctatgttgtgatcggcctgttgtttatgattctgactgtcgcagccaacgaaatggggttactagagacaacgaagaaagatctgggaatcggctacgtagctgcggagaaccatcagcacgccaccatgctcgacgtggatcttcgtcccgcatctgcttggactctgtacgccgttgccacaaccgtgattaccccaatgatgagacacacaatcgaaaatactacggcaaacataagcttgaccgctattgccaatcaagcggctatcctgatgggtctcgacaaggggtggcctatttccaaaatggatatcggcgtcccgctgcttgccttaggatgctattcacaggtgaaccccctgacactcactgcagccgtcttgatgctggtggctcattacgcaataatcggcccagggctacaggccaaggcgaccagggaggctcagaagcgcacagccgcaggaattatgaaaaatcctaccgttgacggcatcgtggccattgatctggaccccgtagtgtatgacgctaagttcgaaaaacaactcggtcagatcatgcttctgatattgtgtacttctcagattctgctcatgcggacgacatgggccctgtgcgagagtatcaccttagcaactgggccacttaccacactgtgggaaggatcgcctggcaagttttggaacactaccatcgctgtcagcatggccaatattttccgaggttcctacctcgcgggcgccgggctagcattctctctgatgaaatcattgggaggcgggagaaggggaacaggcgctcagggtgagacgctgggggagaagtggaagcgccaactcaaccagcttagcaaatccgaatttaatacctataagcggagtggaatcatggaggttgatagatctgaagccaaagagggcctgaagcgtggtgaaactacaaaacacgcagtgagcaggggcaccgctaagttgcggtggttcgtcgagcgcaacctggtgaagcccgaggggaaagtaatagacctcggatgtggccgagggggatggtcatactattgcgccggcttaaagaaagtgactgaagttaagggttacacaaaagggggaccgggccatgaggaaccaattcctatggccacctacggctggaatctggtgaagcttcactccgggaaagatgtctttttcatgcccccagagaagtgtgacacgctgctatgcgatatcggagaaagtagccccaaccctaccattgaggagggtagaacactcagggtgctgaagatggtcgaaccgtggttgcggggcaatcagttttgtatcaaaatactgaacccctatatgccatctgtggttgagactctcgaacagatgcaacgcaagcatgggggaatgcttgtaagaaatcctctgtccaggaactcaacccacgagatgtactgggtgagctgcggcacaggtaatatcgtctcggcggtgaacatgacttctcgaatgttactgaaccggttcaccatggctcaccgtaaacccacatatgagagagacgttgatttgggggcaggaacccgccatgtggccgtcgaacctgaggaagctaatctcgacattatcggccagaggattgagaacatcaagaatgaacacaaaagtacttggcattacgatgaggacaacccatataagacgtgggcctaccacggctcctatgaggtgaagcccagcgggtcagcatcctctatggtaaatggagtggttcggctgctaacaaaaccttgggatgtcattccaatggtgacccagatcgccatgactgacaccacaccctttggtcaacagagagtgttcaaggaaaaagtcgacacgcgcaccccgagggctaagcgaggcactacacagataatggaggttaccgcgaaatggctttgggggtttctgagccggaacaagaagcctagaatttgtactagggaagagttcacacgcaaagtgcgtagtaatgccgcaatcggagctgtatttgtggatgaaaaccagtggaattccgccaaggaggcagtcgaggacgaacggttctgggatctcgtgcacagagagagggaactgcataaacaaggcaagtgcgccacctgcgtttacaacatgatgggtaaacgcgagaagaagttgggggaatttggaaaagctaagggcagccgagccatctggtacatgtggctgggcgcgcggttcctcgagttcgaggcacttgggtttatgaatgaagaccactggttctctagagagaactcactgagtggagtggaaggtgagggcttacataaactggggtatattttgagggatatatccaagatcccaggaggcaatatgtacgccgacgatacagctggttgggacactcgcattaccgaggatgacctccagaacgaagccaaaatcacggatattatggagcccgaacacgcactgctagctaccagcatctttaagcttacatatcagaataaagtcgtgagagtacagcggcctgccaagaacgggactgttatggacgtgatatctaggcgtgatcaacgaggatcgggccaggtcggcacctacgggctgaacacattcactaatatggaggtgcagctcatccgccagatggaatcagagggaatttttctgccaagcgagttggaaacccccaacttagctgagagagtgctggactggctcgaaaagcatggtgccgagcggcttaaaaggatggcaatctccggcgacgattgtgtcgttaagccgattgacgatcgcttcgcgacggccctgacagctctaaatgacatggggaaagtgagaaaggatatccctcaatgggaacccagtaaaggatggaacgactggcagcaggtaccattttgctctcaccacttccatcagctgataatgaaggatggccgggagattgtggtcccttgtaggaatcaagacgagctcgtgggtcgagcccgtgttagccagggggcaggatggtccttgagagaaaccgcttgcctgggcaagtcatatgcccagatgtggcaacttatgtactttcaccgccgggatctgaggctcgcagccaacgcgatctgtagtgctgtgcccgtcgactgggtgccaacttctagaacaacctggagcatccatgcccaccaccagtggatgactaccgaggatatgttatccgtatggaatcgcgtttggattgaagagaacccctggatggaagacaaaacacatgtgtcaagctgggaggaggtcccttatctgggcaagcgggaagaccagtggtgcgggtctttgataggactgacggcaagggccacctgggctactaatatccaggtggccattaaccaagttcgaagactcatcggtaatgagaactacattgattacatgacatccatgaaacggttcaagaatgaaagtgacccagagggcgcactttggtga

SEQ ID NO: 13240 - RNA, 9879 nt, synthetic construct
  misc_feature 1..9879: note = derived and/or modified CDS sequence (opt3) from DENV-1__GQ868561__SS-prME
  source 1..9879: mol_type = other RNA
agcgtgaccatgctgctcatgcttctgcccactgccttggctttccacttaactacgagaggaggggagcctcatatgatcgtctccaagcaggaaagaggaaaatctctgctatttaagacctcagctggtgttaacatgtgcaccctcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggctccccatgtcggcttgggtctcgagactagaaccgaaacatggatgtcctctgagggggcctggaaacagatccagagggtggaaacttgggccctgcggcaccctggattcaccgttattgcatttttcctggcccatgctatcggcacatcgattacccagaagggcatcatatttatcctcttaatgctggtgacgccatcaatggccatgcgctgcgtcgggattggaaacagagatttcgtggagggtcttagcggcgcgacttgggtagacgttgtgttggagcacgggagttgtgtcacaaccatggcaaagaataaacccactctggatatcgaactactcaagacagaggtgaccaaccctgccgtgctgaggaaactttgcattgaagctaagatctccaatacgaccacagactctcggtgtccaactcaaggagaggccaccctggtcgaagaacaggatgcaaactttgtttgccgccgaacattcgtggacagaggctggggtaatgggtgtggattgtttggcaaaggcagcctcctgacttgcgctaagttcaagtgcgtaaccaaattagaggggaagatagtgcagtacgaaaacctgaaatattccgtcattgtgacagttcacaccggagatcagcatcaagtgggtaatgagactacggaacacggcacaatcgccaccattactccccaggcgcctacctcagagatccagctcacagactacggggcccttaccctggactgtagtccaaggactggattggattttaacgaaatggtcctactgacaatgaaggagaaaagctggctcgtgcataagcagtggttcctggaccttccgctgccctggacgtctggcgcatccacctcacaagagacttggaatcggcaggatttgctcgtaacatttaaaaccgctcacgccaagaagcaggaagttgtggtcctgggtagccaagagggggctatgcacacagccttaactggcgcaaccgaaatccagacgagtggaaccacaactattttcgccggccatctgaaatgccgtctaaagatggacaaactcaccctgaaggggatgtcttatgtgatgtgtacaggatccttcaaacttgagaaggaagtcgctgagactcagcacggtaccgtgttggttcaggtgaagtacgagggcacggatgcgccttgcaaaataccatttagcacacaagacgaaaagggggtaacccagaacggacgcctgatcactgcaaatcccattgtcacagataaagagaagcctgtgaacatcgaaaccgagccacccttcggcgagtcgtatatagttgtgggtgccggggaaaaagctctcaagctgtcttggtttaagaaaggctcctcaattggaaagatgttcgaggccactgcaagaggcgccaggcggatggctatccttggggacaccgcctgggattttggaagtatcggtggcgtcttcacaagcgtggggaaactggtacatcaggtgtttggaacggcatacggcgttttgttctccggtgtctcttggaccatgaagattgggatcggcattctcctgacttggttaggactgaatagccgatcaacaagtctatccatgacctgtatagcggtgggcatggtgacactctacctgggggtcatggttcaggctgacagcggatgcgtgatcaactggaaaggccgcgaacttaagtgtggttctgggatttttgtgactaacgaggtacacacctggacggaacaatataagttccaggccgattcaccgaaaagattgagtgcagccatcggaaaggcttgggaggagggcgtctgcggtatcaggagcgccacacggctggaaaatattatgtggaaacagatatccaacgagctcaatcatatcctgttagaaaacgacatgaagtttaccgtggttgtgggcgacgcaaatgggattctggctcagggcaagaagatgatccgccctcaacccatggagcacaaatactcttggaagtcgtggggcaaggccaaaattatcggggcggatatacagaacactaccttcatcattgacggaccagatacacctgaatgtcccgacggccagagagcctggaatatctgggaggtcgaggattatggttttgggattttcactaccaacatctggcttaagttgagggacagctacacacagatgtgcgatcaccgtctcatgtccgctgcaataaaagactcaaaggccgtgcatgctgatatgggatattggattgaaagtgagaaaaatgaaacgtggaagctggcccgggcatctttcatcgaggttaagacctgtacttggccaaaaagccacacactatggtccaacggcgtgctggaatcagagatgattatccccaagatatacggtggccctatcagccaacataattatcgaccagggtactttacccagactgcgggaccgtggcacctcggcaaactggagcttgacttcgatttgtgcgaagggacaaccgtagtcgtggacgagcactgcggaaacagaggcccctctctgaggacgactaccgtgacaggtaagattatccatgaatggtgttgccgctcctgtaccttacctccactccggtttagaggggaggatggatgctggtacggcatggagattaggcccgtcaaagaaaaggaggaaaatctggttcgcagtatggtgagcgccggttctggcgaggtagactccttctcacttgggatcctgtgtgtgagtataatgattgaagaggtcatgcgaagccggtggtcgcgtaagatgttgatgactggaacactcgctgtgtttctgctactgatcatgggccagctcacctggaacgacctgatcagactttgcattatggttggggccaatgcatccgataggatgggaatgggcacaacttatttggctctgatggccaccttcaaaatgcgccctatgtttgcagtgggtttactcttccggagactgacgtctagggaggtccttctgctaacaatcgggctcagcctggtggcctcagttgaattgccaaacagtctggaggaattaggagacggcctcgctatgggcattatgatgctgaaacttctgaccgagtttcaaccccaccagttgtggactaccctcctgtccctaacattcgtgaaaactaccctgtctcttgattacgcgtggaagacgacagccatggtcctcagcatagtatccctgtttccgttgtgtctgtcaaccactagccagaaaacaacctggttacctgtgctcctggggagtttcggatgcaagccacttactatgtttctgatcacagaaaacaagatttggggtcgaaaatcttggcccttgaatgagggcatcatggcaattgggatcgtttccatactcctgagctcgctactgaagaacgacgtgcctcttgctggacccctcatcgccggcggtatgctgattgcctgttatgtcatctcagggtctagtgctgatttgtccttagagaaagcagccgaagtgagctgggagcaggaagcggagcattctggagctagccacaatattctggtagaagtgcaagacgatggcaccatgaagatcaaagacgaggagcgcgatgacacgctcactatactgcttaaggccaccctgttggcagtctccggcgtttacccaatgtcaattcctgccacactattcgtgtggtatttctggcagaaaaagaagcagcggagtggggtgctgtgggatacccccagcccaccggaagtcgagagagctgtgctcgacgatggaatctacaggatcctgcagcgtggtcttttaggccgctctcaagttggggtaggagtgtttcaggacggcgtcttccatacaatgtggcacgtgactcggggtgcagttctgatgtatcaggggaaaagactcgaaccttcctgggcctcagtgaagaaagacttgattagttacggaggcggctggaggtttcaggggagctggaacaccggagaggaggtccaagtgatagcggtagaacccggtaagaatcccaaaaatgtccagacgacacccggcactttcaagacccctgagggggaagtgggagctatcgccctggattttaagccaggcacatccggttctcccattgttaatcgagaggggaaaatcgtgggactctacggcaacggcgtcgtgaccacttcggggacctatgttagcgcaattgcccaggctaaggcctcacaagaaggacctctgccggagatcgaggacgaagtgttcaaaaagcggaatcttacaataatggatctgcacccaggttccggcaaaacgcgcagatacttgcccgcaatcgtcagggaggctattaagcggaagctacgaactctgatcctcgcccctaccagagtggtagcgagtgaaatggccgaggcattaaaagggatgccaattcgctatcagacaaccgctgtgaagtctgaacatactggaagggagatcgttgacctgatgtgccacgccacatttaccatgcgtcttctgagccccgtccgggtgcctaactacaatatgataattatggatgaggctcatttcacggacccggcatccatcgccgccagaggctatatctcaactagggtgggtatgggggaagctgcggcaatttttatgacagccacaccaccaggatctgtcgaggctttccctcagagcaacgccgtaatccaggatgaagaacgcgacatacccgaacgaagttggaactccggctacgattggattaccgactttccaggcaaaactgtgtggttcgttcctagcatcaagtctgggaacgatattgcaaattgtctcaggaaaaacggaaagcgggtgatccaattgtcaaggaagacattcgacaccgagtatcagaaaacaaagaacaatgactgggattacgtcgtgactacggacatatccgagatgggtgccaactttcgcgctgatcgtgttattgaccccagacggtgcctgaaaccagtgatcctcaaggatggcccggaaagggtcatcctggcggggcctatgcccgtgaccgtagccagtgcagctcagcgccgaggaagaattggccggaatcagaacaaagagggtgaccaatacgtgtatatggggcagccacttaataacgatgaagaccacgcccattggacagaggcaaagatgctactggataatatcaacactcccgagggcattatacctgccttgttcgaaccagagagggaaaagagcgctgccatcgacggagagtaccgcttaagaggcgaagcgaggaaaacctttgttgagctgatgcggcgtggggatctccccgtctggctgtcgtataaggtggcatctgagggattccagtactccgaccgccgatggtgctttgatggtgaaagaaataaccaggtgcttgaggaaaatatggacgtcgagatttggacaaaagaaggcgagaggaagaaactgcggcctcgctggctcgacgccagaacctatagcgatccgttggctctgagggagttcaaggaatttgccgctgggcggcgatcagttagtggagacctaatcctggagatcggcaaactcccacaacaccttactctgagagcacagaacgccttagataatttggtgatgctgcacaactctgaacagggtgggaaggcttaccgccatgccatggaggaactccccgacacgattgagaccctgatgcttctggcactcatagcggtattgacaggcggagtgactctgttctttttatccggcaaggggctaggaaaaaccagcatcggtctgctctgtgtcacagcctcaagtgcacttctgtggatggccagcgtggagcctcactggattgcagcttccatcattttggagttctttctgatggttctcctgatccccgagccagataggcagcggacccctcaagacaatcagcttgcctatgtggtcataggcctcctgttcatgatcttgactgtagcagccaacgaaatggggctgttagagacaacgaagaaagatctaggaattggctacgtggctgcggagaaccatcagcacgccaccatgctggacgttgatctccgtcccgcatctgcttggactctttacgccgtggccacaaccgtcatcaccccaatgatgagacacacaattgaaaatactacggcaaacatcagcctgaccgctatagccaatcaagcggctattttgatgggtctggacaaggggtggcctatctccaaaatggatattggcgtgccgctcctggcccttggatgctattcacaggtcaaccccttaacactgactgcagccgtgctcatgttggttgctcattacgcaatcataggcccagggctgcaggccaaggcgaccagggaggctcagaagcgcacagccgcaggaatcatgaaaaatcctaccgtggacggcattgtagccatcgatctagaccccgtggtctatgacgctaagtttgaaaaacaactgggtcagattatgctccttatcctgtgtacttctcagatattgctgatgcggacgacatgggccctctgcgagagtattaccctggcaactgggccattaaccacactttgggaaggatcgcctggcaagttctggaacactaccatcgctgttagcatggccaatatcttccgaggttcctacctggcgggcgccgggctcgcattttctctaatgaaatcactgggaggcgggagaaggggaacaggcgctcagggtgagacgttgggggagaagtggaagcgccaactgaaccagctcagcaaatccgagttcaatacctataagcggagtggaattatggaggtggatagatctgaagccaaagagggccttaagcgtggtgaaactacaaaacacgcagtcagcaggggcaccgctaagctgcggtggtttgtggagcgcaacttggtaaagcccgaggggaaagtgatcgacctgggatgtggccgagggggatggtcatactattgcgccggcctcaagaaagttactgaagtgaagggttacacaaaagggggaccgggccatgaggaaccaatacctatggccacctacggctggaatttagtcaagctgcactccgggaaagatgtgttctttatgcccccagagaagtgtgacacgcttctgtgcgatattggagaaagtagcccctctcctaccatcgaggagggtagaacactaagggtcctcaagatggtggaaccgtggctgcggggcaaccagttctgtattaaaatcttgaatccctatatgccatccgttgtagagactctggaacagatgcaacgcaagcatgggggaatgctcgtgagaaaccctctttcaaggaatagcacccacgagatgtactgggtctcgtgcggcacaggtaacatagtgtctgcggttaatatgacaagtcgaatgctgttaaaccggtttaccatggctcaccgtaaacccacatatgagagagacgtggatctgggggcaggaacccgccatgtcgccgtggaacctgaggtagctaacttggacatcattggccagaggatcgaaaatattaagaacgagcacaaatccacttggcattacgatgaagacaatccatataagacgtgggcctaccacggcagctatgaggtgaagccctcagggtccgcatctagcatggttaacggagtcgtgcggctcctgacaaaaccttgggatgtgatcccaatggtcacccagattgccatgactgacaccacacccttcggtcaacagagagtttttaaggagaaagtggacacgcgcaccccgagggctaagcgaggcactacacagatcatggaagtaaccgcgaaatggctatgggggttccttagtcggaataagaagcctagaatatgtactagggaggaatttacacgcaaagtgcgttccaacgccgcaattggagctgtcttcgtggatgagaatcagtggaacagcgccaaggaagcagttgaggacgagcggttttgggatctggtgcacagagaaagggagctccataaacaaggcaagtgcgcaacctgcgtctacaatatgatgggtaaacgcgaaaagaagctgggggagttcggaaaagctaagggctctcgagccatctggtacatgtggttgggcgcgcggttcctggaatttgaggcactcgggttcatgaacgaggaccactggttttcaagagaaaatagtctttccggagtggagggtgaaggcctgcataaattagggtatatcctgagggatattagcaagataccaggaggcaacatgtacgccgacgatacagctggttgggacactcgcatcaccgaggatgacttgcagaatgaggccaaaattacggatatcatggaacccgagcacgcactcctggctacctctattttcaagctaacatatcagactaaagtagttagagtgcagcggcctgccaagaacgggaccgtcatggacgtgatctcgaggcgtgatcaacgaggatcaggccaggtgggcacatacgggcttaatacttttaccaacatggaagtccagctgatacgccagatggagagcgaaggaatcttcctcccatccgagctggagacgcccaacttggctgaaagagttttagactggctggagaagcatggtgccgaacggctcaaaaggatggcaattagtggcgacgattgtgtggtaaagccgatcgacgatcgctttgcgacagcccttaccgctctgaatgacatggggaaagtgagaaaggatattcctcaatgggagccctctaaaggatggaacgactggcagcaggtcccattctgcagccaccactttcatcagctaatcatgaaggatggccgggaaatagtggttccttgtaggaatcaagacgagctggtgggtcgagcccgtgtctcccagggggcaggatggtcactcagagagactgcttgcttgggcaagagttatgcccagatgtggcaactgatgtacttccaccgccgggatcttaggctggcagccaacgcgatttgttctgctgtgcccgtagactgggttccaacaagcagaaccacttggtccatccatgcccaccaccagtggatgaccacagaagatatgctctcagtgtggaatcgcgtctggatcgaggaaaacccctggatggaggacaaaacgcatgtgagctcttgggaagaggttccttatttaggcaagcgggaggaccagtggtgcgggtccctgattggattgaccgcaagggccacttgggctacaaatatacaggtggccatcaaccaagtccgaagactgattggtaatgaaaactacctcgattacatgaccagtatgaaacggtttaagaatgagagcgacccagaaggcgcactttggtga

SEQ ID NO: 13241 - RNA, 9879 nt, synthetic construct
  misc_feature 1..9879: note = derived and/or modified CDS sequence (opt3) from DENV-1__GU131948__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaaacagatccagagggtggaaacttgggctctgcggcaccctggattcaccgttattgcactgtttctcgcccatgctatcggcacatcgattacccagaagggcatcatattcatcttactgatgcttgtgacgccatcaatggccatgcgctgcgtcgggattggaaacagagattttgtggagggtttgagcggcgcgacttgggtagacgttgtgctggagcacgggagttgtgtcacaaccatggcaaagaataaacccactctagatatcgaactcctgaagacagaggtgaccaaccctgccgtgcttaggaaactgtgcattgaagctaagatctccaatacgaccacagactctcggtgtccaactcaaggagaggccaccttggtcgaagagcaggatgcaaacttcgtttgccgccgaacatttgtggacagaggctggggtaatgggtgtggactcttcggcaaaggcagcctgttaacttgcgctaagtttaagtgcgtaaccaaactggaggggaagatagtgcagtacgaaaacctcaaatattccgtcattgtgacagttcacaccggagatcagcatcaagtgggtaatgagactacggaacacggcacaatcgccaccattactccccaggcgcctacctcagagatccagcttacagactacggggccctgaccttggactgtagtccaaggactggactagatttcaacgaaatggtcctgctcacaatgaaggagaaaagctggctggtgcataagcagtggtttcttgacctgccgttgccctggacgtctggcgcatccacctcacaagagacttggaatcggcaggatctcctggtaacattcaaaaccgctcacgccaagaagcaggaagttgtggtcttaggtagccaagagggggctatgcacacagccctgactggcgcaaccgaaatccagacgagtggaaccacaactatttttgccggccatctaaaatgccgtctcaagatggacaaactgacccttaaggggatgtcttatgtgatgtgtacaggatccttcaaattggagaaggaagtcgctgagactcagcacggtaccgtgctggttcaggtgaagtacgagggcacggatgcgccttgcaaaataccattcagcacacaagacgaaaagggggtaacccagaacggacgcctcatcactgcaaatcccattgtcacagataaagagaagcctgtgaacatcgaaaccgagccaccctttggcgagtcgtatatagttgtgggtgccggggaaaaagctctgaagctttcttggttcaagaaaggctcctcaattggaaagatgtttgaggccactgcaagaggcgccaggcggatggctatcctgggggacaccgcctgggatttcggaagtatcggtggcgtctttacaagcgtggggaaattggtacatcaggtgttcggaacggcatacggcgttctcttttccggtgtctcttggaccatgaagattgggatcggcattctgttaacttggctgggactaaatagccgatcaacaagtctctccatgacctgtatagcggtgggcatggtgacactgtaccttggggtcatggttcaggctgacagcggatgcgtgatcaactggaaaggccgcgaattgaagtgtggttctgggattttcgtgactaacgaggtacacacctggacggaacaatataagtttcaggccgattcaccgaaaagactgagtgcagccatcggaaaggcttgggaggagggcgtctgcggtatcaggagcgccacacggctcgaaaatattatgtggaaacagatatccaacgagctgaatcatatcttactggaaaacgacatgaagttcaccgtggttgtgggcgacgcaaatgggattcttgctcagggaaaaaagatgatccgccctcaacccatggagcacaaatactcttggaagtcgtggggcaaggccaaaattatcggggcggatatacagaacactacctttatcattgacggaccagatacacctgaatgtcccgacggccagagagcctggaatatctgggaggtcgaggattatggtttcgggatttttactaccaacatctggttgaagctcagggacagctacacacagatgtgcgatcaccgtctgatgtccgctgcaataaaagactcaaaggccgtgcatgctgatatgggatattggattgaaagtgagaaaaatgaaacgtggaagctagcccgggcatctttcatcgaggttaagacctgtacttggccaaaaagccacacactgtggtccaacggcgtgctcgaatcagagatgattatccccaagatatacggtggccctatcagccaacataattatcgaccagggtacttcacccagactgcgggaccgtggcacctgggcaaacttgagttggactttgatctgtgcgaagggacaaccgtagtcgtggacgagcactgcggaaacagaggcccctctttaaggacgactaccgtgacaggtaagattatccatgaatggtgttgccgctcctgtaccctccctccactgcggttcagaggggaggatggatgctggtacggcatggagattaggcccgtcaaagaaaaggaggaaaatcttgttcgcagtatggtgagcgccggttctggcgaggtagactccttttcactggggatcttgtgtgtgagtataatgattgaagaggtcatgcgaagccggtggtcgcgtaagatgctcatgactggaacactggctgtgttcctactgctcatcatgggccagctgacctggaacgaccttatcagattgtgcattatggttggggccaatgcatccgataggatgggaatgggcacaacttatctggctttaatggccacctttaaaatgcgccctatgttcgcagtgggtctcctgtttcggagacttacgtctagggagatcctgctactcacaattgggctgagcttggtcgcctcagtggaactgccaaacagtttagaggaactcggagacggcctggctatgggcataatgatgcttaagctgttgaccgagttccaaccccaccagctctggactaccctgctatccctgacatttgttaaaactaccctttctctcgattacgcgtggaagacgacagccatggtgctgagcatcgtctccttgttcccgctgtgtttatcaaccactagccagaaaacaacctggctccctgtactgcttgggagttttggatgcaagccactgactatgttcttgattacagaaaacaagatctggggtcgaaaatcttggcccctcaatgagggcattatggcaatcgggatagtgtccatcctgctaagctcgctgcttaagaacgacgttcctctcgctggacccctgattgccggcggtatgttgatcgcctgttatgtgatttcagggtctagtgctgatttatccctggagaaagcagccgaagtcagctgggagcaggaagcggagcattctggagctagccacaatatcctcgtggaagtacaagacgatggcaccatgaagataaaagacgaggagcgcgatgacacgctgactattcttctgaaggccaccttgctagcagtgtccggcgtctacccaatgtcaatccctgccacactgtttgtttggtatttctggcagaaaaagaagcagcggagtggggtgctctgggatacccccagcccaccggaagtggagagagctgtcctggacgatggaatctacaggattcttcagcgtggtttactgggccgctctcaagtgggggttggagtattccaggacggcgtgtttcatacaatgtggcacgtcactcggggtgcagtgctcatgtatcaggggaaaagattggaaccttcctgggcctcagttaagaaagacctgataagttacggaggcggctggaggttccaggggagctggaacaccggagaggaggtgcaagtcatcgcggtggaacccggtaagaatccaaaaaacgtacagacgacacccggcatttttaagactcctgagggggaagtcggagctatcgccctcgatttcaagccaggcacctccggttctcccattgtgaatcgagaggggaaaatcgttggactgtacggcaacggcgtggtcacaacctcggggacttatgtgagcgcaatagcccaggctaaggcctcacaagaaggacctcttccggagatcgaggacgaagtttttaaaaagcggaatctgaccattatggatttgcacccaggttccggcaaaacacgcagatacctacccgcaatcgtgagggaggctattaagcggaagctgcgaacgctcatcttagcccctactagagtcgtggcgagtgaaatggccgaggcactgaaagggatgccaatacgctatcagaccacagctgtaaagtctgaacataccggaagggagattgtggaccttatgtgccacgccactttcacaatgcgtctgctcagccccgttcgggtccctaactacaatatgatcatcatggatgaggctcattttaccgacccggcatccattgccgccagaggctatatctcaacgagggtgggtatgggggaagctgcggcaatattcatgactgccacacccccaggatctgtggaggcttttcctcagagcaacgccgtcattcaggatgaagagcgcgacatccccgaacgaagttggaattccggctacgattggattaccgacttcccaggcaaaaccgtatggtttgtgcctagcatcaagtctgggaacgatatagcaaattgtttgagaaaaaacggaaagcgggttattcaactgtcaaggaagactttcgacacagagtatcagaaaaccaagaacaatgactgggattacgtggtcacaactgacatctccgagatgggtgccaacttccgcgctgatcgtgtgatcgaccccagacggtgcctcaaaccagttattctgaaggatggcccggaaagggtgatccttgcggggcctatgcccgtcacggtggccagtgcagctcagcgccgaggaagaattggccggaatcagaacaaagagggtgaccaatacgtatatatggggcagccactaaataacgatgaagaccacgcccattggaccgaggcaaagatgctgttggataatataaacacacccgagggcatcattcctgccttatttgaaccagagagggaaaagagcgctgccatcgacggagagtaccgcctgagaggcgaagcgaggaaaactttcgtggagctcatgcggcgtggggatctgcccgtttggctttcgtataaggtcgcatctgagggatttcagtactccgaccgccgatggtgcttcgatggtgaaagaaataaccaggtgctggaggaaaatatggacgtggagatctggaccaaagaaggcgagaggaagaaactccggcctcgctggttggacgccagaacatatagcgatccgctggctctaagggagtttaaggaattcgccgctgggcggcgatcaattagtggagacctgatactcgagatcggcaaacttccacaacacctgaccttaagagcacagaacgccttggataatctggtcatgctccacaactctgaacagggtgggaaggcttaccgccatgccatggaggaactgcccgacactattgagacgcttatgctgctcgcattgatcgcggttctgaccggcggagtgacattatttttcctatccggcaaggggctgggaaaaactagcattggtctcctttgtgtaaccgcctcaagtgctctgttgtggatggccagcgtggagcctcactggatcgcagcttccataatcctggaatttttcctcatggtcctgcttattcccgagccagataggcagcggacacctcaagacaatcagctcgcctatgtggttatcggcctgttgtttatgattctgaccgtggcagccaacgaaatggggttactagagactacaaagaaagatctgggaatcggctacgtcgctgcggagaaccatcagcacgccacgatgctcgacgtagatcttcgtcccgcatctgcttggaccctgtacgccgtggccactacagttataaccccaatgatgagacacaccattgaaaatacaactgcaaacatcagcttgacggctattgccaatcaagcggctatcctgatgggtctcgacaaggggtggcctatatccaaaatggatatcggcgtgccgctgcttgccttaggatgctattcacaggtcaaccccctgaccctcacagcagccgtgttgatgctggtcgctcattacgcaattatcggcccagggctacaggccaaggcgactagggaggctcagaagcgcaccgccgcaggaattatgaaaaatcctacagtggacggcatcgttgccatagatctggaccccgtggtatatgacgctaagttcgaaaaacaactcggtcagattatgcttctgatcttgtgtacctctcagatcctgctcatgcggactacgtgggccctgtgcgagagtattacattagcaaccgggccacttactaccctgtgggaaggatcgcctggcaagttttggaacacaactatcgctgtgagcatggccaatatattccgaggttcctacctcgcgggcgccgggctagcattctctctgatgaaatcattgggaggcgggagaaggggaaccggcgctcagggtgagacactgggggagaagtggaagcgccaactcaaccagcttagcaaatccgaatttaatacgtataagcggagtggaattatggaggtcgatagatctgaagccaaagagggcctgaagcgtggtgaaaccactaaacacgcagttagcaggggcacagctaagttgcggtggttcgtggagcgcaacctggtcaagcccgaggggaaagtgatcgacctcggatgtggccgagggggatggtcatactattgcgccggcttaaagaaagtaaccgaagtgaagggttacactaaagggggaccgggccatgaggaaccaattcctatggccacatacggctggaatctggttaagcttcactccgggaaagatgtgtttttcatgcccccagagaagtgtgacaccctgctatgcgatatcggagaaagtagccccaaccctacgatagaggagggtagaaccctcagggtcctgaagatggtggaaccgtggttgcggggcaatcagttttgtatcaaaattctgaacccctatatgccatctgtcgtggagacactcgaacagatgcaacgcaagcatgggggaatgcttgttagaaatcctctgtccaggaactcaactcacgagatgtactgggtaagctgcggcaccggtaatatcgtgtcggcggtcaacatgacatctcgaatgttactgaaccggttcactatggctcaccgtaaacccacctatgagagagacgtggatttgggggcaggaacacgccatgttgccgtggaacctgaggtcgctaatctcgacattatcggccagaggattgaaaacatcaagaatgagcacaaaagtacctggcattacgatgaagacaacccatataagacttgggcctaccacggctcctatgaggtgaagcccagcgggtcagcatcctctatggtaaatggagtggttcggctgctaacgaaaccttgggatgtcataccaatggtgacacagattgccatgaccgacactaccccctttggtcaacagagagtgttcaaggagaaagtcgacacacgcacgccgagggctaagcgaggcaccactcagatcatggaagttacagcgaaatggctttgggggtttctgagccggaacaagaagcctagaatctgtaccagggaggaattcactcgcaaagtgcgtagtaatgccgcaattggagctgtatttgtggatgagaaccagtggaattccgccaaggaagcagtcgaggacgagcggttctgggatctcgtgcacagagaaagggagctgcataaacaaggcaagtgcgccacatgcgtttacaacatgatgggtaaacgcgaaaagaagttgggggagtttggaaaagctaagggcagccgagccatatggtacatgtggctgggcgcgcggttcctcgaattcgaggcacttgggtttatgaatgaggaccactggttctctagagaaaactcactgagtggagtggagggtgaaggcttacataaactggggtatatcttgagggatatttccaagatcccaggaggcaatatgtacgccgacgataccgctggttgggacacacgcattactgaggatgacctccagaacgaggccaaaatcaccgatataatggaacccgagcacgcactgctagctacgagcatctttaagcttacctatcagaataaagtcgtgagagtacagcggcctgccaagaacgggacagttatggacgtgatttctaggcgtgatcaacgaggatcgggccaggtcggcacttacgggctgaacaccttcacaaatatggaagtgcagctcatccgccagatggagtcagaaggaatttttctgccaagcgagttggagactcccaacttagctgaaagagtgctggactggctcgagaagcatggtgccgaacggcttaaaaggatggcaatctccggcgacgattgtgtcgttaagccgatagacgatcgcttcgcgaccgccctgacggctctaaatgacatggggaaagtgagaaaggatacacctcaatgggagcccagtaaaggatggaacgactggcagcaggtaccattttgctctcaccacttccatcagctgattatgaaggatggccgggaaatcgtggtcccttgtaggaatcaagacgagctcgtgggtcgagcccgtgttagccagggggcaggatggtccttgagagagaccgcttgcctgggcaagtcatatgcccagatgtggcaacttatgtactttcaccgccgggatctgaggctcgcagccaacgcgatctgtagtgctgtgcccgtcgactgggtgccaacttctagaacaacctggagcattcatgcccaccaccagtggatgactaccgaagatatgttatccgtatggaatcgcgtttggatagaggaaaacccctggatggaggacaaaacacatgtgtcaagctgggaagaggtcccttatctgggcaagcgggaggaccagtggtgcgggtctttgatcggactgacggcaagggccacctgggctactaatattcaggtggccatcaaccaagttcgaagactcattggtaatgaaaactaccttgattacatgacatccatgaaacggttcaagaatgagagtgacccagaaggcgcactgtggtga

SEQ ID NO: 13242 - RNA, 9879 nt, synthetic construct
  misc_feature 1..9879: note = derived and/or modified CDS sequence (opt3) from DENV-1__GQ868562__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaaacagatccagagggtggaaacttgggctctgcggcaccctggattcaccgttattgcactgtttctcgcccatgctatcggcacatcgattacccagaagggcatcatattcatcttactgatgcttgtgacgccatcaatggccatgcgctgcgtcgggattggaaacagagattttgtggagggtttgagcggcgcgacttgggtagacgttgtgctggagcacgggagttgtgtcacaaccatggcaaagaataaacccactctagatatcgaactcctgaagacagaggtgaccaaccctgccgtgcttaggaaactgtgcattgaagctaagatctccaatacgaccacagactctcggtgtccaactcaaggagaggccaccttggtcgaagagcaggatgcaaacttcgtttgccgccgaacatttgtggacagaggctggggtaatgggtgtggactcttcggcaaaggcagcctgttaacttgcgctaagtttaagtgcgtaaccaaactggaggggaagatagtgcagcacgaaaacctcaaatactccgtcattgtgacagttcataccggagatcagcaccaagtgggtaatgagactacggaacatggcacaatcgccaccattactccccaggcgcctacctcagagatccagcttacagactatggggccctgaccttggactgtagtccaaggactggactagatttcaacgaaatggtcctgctcacaatgaaggagaaaagctggctggtgcacaagcagtggtttcttgacctgccgttgccctggacgtctggcgcatccacctcacaagagacttggaatcggcaggatctcctggtaacattcaaaaccgctcacgccaagaagcaggaagttgtggtcttaggtagccaagagggggctatgcatacagccctgactggcgcaaccgaaatccagacgagtggaaccacaactatttttgccggccacctaaaatgccgtctcaagatggacaaactgacccttaaggggatgtcttacgtgatgtgtacaggatccttcaaattggagaaggaagtcgctgagactcagcatggtaccgtgctggttcaggtgaagtatgagggcacggatgcgccttgcaaaataccattcagcacacaagacgaaaagggggtaacccagaacggacgcctcatcactgcaaatcccattgtcacagataaagagaagcctgtgaacatcgaaaccgagccaccctttggcgagtcgtacatagttgtgggtgccggggaaaaagctctgaagctttcttggttcaagaaaggctcctcaattggaaagatgtttgaggccactgcaagaggcgccaggcggatggctatcctgggggacaccgcctgggatttcggaagtatcggtggcgtctttacaagcgtggggaaattggtacaccaggtgttcggaacggcatatggcgttctcttttccggtgtctcttggaccatgaagattgggatcggcattctgttaacttggctgggactaaatagccgatcaacaagtctctccatgacctgtatagcggtgggcatggtgacactgtaccttggggtcatggttcaggctgacagcggatgcgtgatcaactggaaaggccgcgaattgaagtgtggttctgggattttcgtgactaacgaggtacatacctggacggaacaatacaagtttcaggccgattcaccgaaaagactgagtgcagccatcggaaaggcttgggaggagggcgtctgcggtatcaggagcgccacacggctcgaaaatattatgtggaaacagatatccaacgagctgaatcacatcttactggaaaacgacatgaagttcaccgtggttgtgggcgacgcaaatgggattcttgctcagggaaaaaagatgatccgccctcaacccatggagcacaaatattcttggaagtcgtggggcaaggccaaaattatcggggcggatatacagaacactacctttatcattgacggaccagatacacctgaatgtcccgacggccagagagcctggaatatctgggaggtcgaggattacggtttcgggatttttactaccaacatctggttgaagctcagggacagctatacacagatgtgcgatcatcgtctgatgtccgctgcaataaaagactcaaaggccgtgcacgctgatatgggatactggattgaaagtgagaaaaatgaaacgtggaagctagcccgggcatctttcatcgaggttaagacctgtacttggccaaaaagccatacactgtggtccaacggcgtgctcgaatcagagatgattatccccaagatatatggtggccctatcagccaacacaattaccgaccagggtatttcacccagactgcgggaccgtggcacctgggcaaacttgagttggactttgatctgtgcgaagggacaaccgtagtcgtggacgagcattgcggaaacagaggcccctctttaaggacgactaccgtgacaggtaagattatccacgaatggtgttgccgctcctgtaccctccctccactgcggttcagaggggaggatggatgctggtacggcatggagattaggcccgtcaaagaaaaggaggaaaatcttgttcgcagtatggtgagcgccggttctggcgaggtagactccttttcactggggatcttgtgtgtgagtataatgattgaagaggtcatgcgaagccggtggtcgcgtaagatgctcatgactggaacactggctgtgttcctactgctcatcatgggccagctgacctggaacgaccttatcagattgtgcattatggttggggccaatgcatccgataggatgggaatgggcacaactcatctggctttaatggccacctttaaaatgcgccctatgttcgcagtgggtctcctgtttcggagacttacgtctagggaggtcctgctactcacaatcgggctgagcttggtggcctcagttgaactgccaaacagtttagaggaactcggagacggcctggctatgggcattatgatgcttaagctgttgaccgagttccaaccccaccagctctggactaccctgctatccctgacatttgtgaaaactaccctttctctcgattacgcgtggaagacgacagccatggtcctgagcatagtatccttgttcccgctgtgtttatcaaccactagccagaaaacaacctggctccctgtgctgcttgggagttttggatgcaagccactgactatgttcttgatcacagaaaacaagatttggggtcgaaaatcttggcccctcaatgagggcatcatggcaattgggatcgtttccatactgctaagctcgctgcttaagaacgacgtgcctctcgctggacccctgatcgccggcggtatgttgattgcctgttatgtcatctcagggtctagtgctgatttatccctggagaaagcagccgaagtgagctgggagcaggaagcggagcattctggagctagccacaatattctcgtagaagtgcaagacgatggcaccatgaagatcaaagacgaggagcgcgatgacacgctgactatacttctgaaggccaccttgctagcagtctccggcgtttacccaatgtcaattcctgccacactgtttgtgtggtatttctggcagaaaaagaagcagcggagtggggtgctctgggatacccccagcccaccggaagtcgagagagctgtgctggacgatggaatctacaggatccttcagcgtggtttactgggccgctctcaagttggggtaggagtgttccaggacggcgtctttcacacaatgtggcatgtgactcggggtgcagttctcatgtatcaggggaaaagattggaaccttcctgggcctcagtgaagaaagacctgattagttacggaggcggctggaggttccaggggagctggaacaccggagaggaggtccaagtgatagcggtagaacccggtaagaatccaaaaaacgtccagacgacacccggcacttttaagacccctgagggggaagtgggagctatcgccctcgatttcaagccaggcacatccggttctcccattgttaatcgagaggggaaaatcgtgggactgtatggcaacggcgtcgtgaccacttcggggacctacgttagcgcaattgcccaggctaaggcctcacaagaaggacctcttccggagatcgaggacgaagtgtttaaaaagcggaatctgacaataatggatttgcacccaggttccggcaaaacgcgcagatacctacccgcaatcgtcagggaggctattaagcggaagctgcgaactctcatcttagcccctaccagagtggtagcgagtgaaatggccgaggcactgaaagggatgccaattcgctatcagacaaccgctgtgaagtctgaacatactggaagggagatcgttgaccttatgtgccacgccacattcaccatgcgtctgctcagccccgtccgggtgcctaactacaatatgataattatggatgaggctcattttacggacccggcatccatcgccgccagaggctatatctcaactagggtgggtatgggggaagctgcggcaattttcatgacagccacccccccaggatctgtcgaggcttttcctcagagcaacgccgtaatccaggatgaagagcgcgacatacccgaacgaagttggaattccggctacgattggattaccgacttcccaggcaaaactgtgtggtttgttcctagcatcaagtctgggaacgatattgcaaattgtttgagaaaaaacggaaagcgggtgatccaactgtcaaggaagacattcgacaccgagtatcagaaaacaaagaacaatgactgggattacgtcgtgactacggacatatccgagatgggtgccaacttccgcgctgatcgtgttattgaccccagacggtgcctcaaaccagtgatcctgaaggatggcccggaaagggtcatccttgcggggcctatgcccgtgaccgtagccagtgcagctcagcgccgaggaagaattggccggaatcagaacaaagagggtgaccaatatgtgtacatggggcagccactaaataacgatgaagaccacgcccactggacagaggcaaagatgctgttggataatatcaacactcccgagggcattatacctgccttatttgaaccagagagggaaaagagcgctgccatcgacggagagtaccgcctgagaggcgaagcgaggaaaaccttcgttgagctcatgcggcgtggggatctgcccgtctggctttcgtataaggtggcatctgagggatttcagtactccgaccgccgatggtgcttcgatggtgaaagaaataaccaggtgctggaggaaaatatggacgtcgagatttggacaaaagaaggcgagaggaagaaactccggcctcgctggttggacgccagaacctatagcgatccgctggctctaagggagtttaaggaattcgccgctgggcggcgatcagttagtggagacctgatcctcgagatcggcaaacttccacaacatctgactttaagagcacagaacgccttggataatctggtgatgctccacaactctgaacagggtgggaaggcttaccgccatgccatggaggaactgcccgacacgattgagacccttatgctgctcgcattgatagcggtactgacaggcggagccactttatttttcctatccggcaaggggctgggaaaaaccagcatcggtctcctttgtgtgacagcttcaagtgccctgttgtggatggcaagcgtcgagcctcactggattgctgcctccatcattctggaatttttcctcatggtgctgcttatccccgagccagataggcagcggacccctcaagacaatcagctcgcatatgttgtgataggcctgttgtttatgatcctgactgtcgccgctaacgaaatggggttactagagacaacgaagaaagatctgggaattggctacgtagcggccgagaaccaccagcatgcaaccatgctcgacgtggatcttcgtcccgcttctgcctggactctgtatgccgttgcaacaaccgtgatcaccccaatgatgagacacacaattgaaaatactacggctaacatcagcttgaccgccatagcgaatcaagctgccattctgatgggtctcgacaaggggtggcctatctccaaaatggatattggcgtcccgctgcttgcattaggatgctactcacaggtgaaccccctgacactcactgccgctgtcttgatgctggtggcacattacgccatcataggcccagggctacaggcgaaggctaccagggaggcccagaagcgcacagcagccggaatcatgaaaaatcctaccgttgacggcattgtggctatcgatctggaccccgtagtgtatgacgccaagttcgaaaaacaactcggtcagattatgcttctgatcttgtgtacttctcagatactgctcatgcggacgacatgggcactgtgcgagagtattaccttagctactgggccacttaccacactgtgggaaggatcgcctggcaagttttggaacactaccatcgccgtcagcatggcgaatatcttccgaggttcctacctcgccggcgcagggctagctttctctctgatgaaatcattgggaggcgggagaaggggaacaggcgcccagggtgagacgctgggggagaagtggaagcgccaactcaaccagcttagcaaatccgaatttaatacctataagcggagtggaattatggaggttgatagatctgaagcaaaagagggcctgaagcgtggtgaaactacaaaacacgctgtgagcaggggcaccgccaagttgcggtggttcgtcgagcgcaacctggtgaagcccgaggggaaagtaatcgacctcggatgtggccgagggggatggtcatactattgcgccggcttaaagaaagtgactgaagttaagggttacacaaaagggggaccgggccatgaggaaccaatacctatggcgacctatggctggaatctggtgaagcttcactccgggaaagatgtctttttcatgcccccagagaagtgtgacacgctgctatgcgatattggagaaagtagccccaaccctaccatcgaggagggtagaacactcagggtgctgaagatggtcgaaccgtggttgaaaggcaatcagttttgtattaagatcctgaacccctacatgccatctgtggttgagactctcgaacagatgcaacggaaacacgggggaatgcttgtacgcaatcctctgtccagaaactcaacccatgagatgtactgggtgagctgcggcacaggtaatatagtctcggctgtgaacatgacttctaggatgttactgaaccgattcaccatggcacaccggaagcccacatatgagcgtgacgttgatttgggggccggaaccagacatgtggctgtcgaacctgaggtggccaatctcgacatcattggccagcgcatcgaaaacattaaaaatgagcacaagagtacttggcactacgatgaagacaacccatataagacgtgggcataccatggctcctatgaggtaaaacccagcgggtcagcctcctctatggtgaatggagttgtcaggctgctaacaaagccttgggatgtgatcccaatggtgacccagattgctatgactgacaccacaccctttggtcaacagcgggtcttcaaagagaaggttgacacgagaaccccgcgcgcgaaaaggggcactacacagatcatggaagtgaccgccaagtggctttgggggtttctgagccgaaacaagaaacctcggatatgtactagagaggaattcacaaggaaggtacgcagtaatgcagctattggagccgtgtttgtcgatgagaaccagtggaattccgcaaaagaagccgtggaggacgagcgtttctgggatctcgttcaccgggaaagagagctgcataagcaaggcaaatgcgctacctgcgtgtacaacatgatgggtaagagggaaaagaaattgggggagtttggaaaggccaaaggcagccgcgcgatctggtatatgtggctgggcgcacgattcctcgaattcgaggcccttgggtttatgaatgaggaccactggttctctcgggaaaactcactgagtggagtcgagggtgaaggcttacataagctggggtacatcttgagagatatttccaaaataccaggaggcaatatgtacgctgacgatacagccggttgggacactaggatcaccgaggatgacctccagaacgaggcaaagattacggatatcatggaacccgagcacgctctgctagccaccagcatttttaaacttacatatcagaataaggtggtacgcgttcagagacctgctaagaacgggactgtgatggacgtcatctctcggagggatcaacgtggatcgggccaggtgggcacctacgggctgaacacattcactaatatggaagtgcagctcatacgacagatggagtcagaaggaatctttctgccaagcgagttggagacccccaacttagccgaacgcgtcctggactggctcgagaaacacggtgcagaaagacttaagcggatggcgatttccggcgacgattgtgttgtgaaaccgatcgacgataggttcgccacggctctgacagccctaaatgacatggggaaggtacgcaaagatattcctcaatgggagcccagtaagggatggaacgactggcagcaggtgccattttgctctcatcacttccatcagctgatcatgaaggatggcagagaaatagtcgtgccttgtcggaatcaagacgagctcgttggtagggcacgagtgagccagggggctggatggtccttgcgtgagaccgcctgcctgggcaaatcatatgcacagatgtggcaacttatgtactttcacagacgcgatctgcggctcgccgcgaacgctatttgtagtgccgtccccgtggactgggtaccaacttctaggacaacctggagcatccacgcacatcaccagtggatgactaccgaagatatgttatccgtttggaatagagtgtggatcgaggaaaacccctggatggaggacaagacacatgtctcaagctgggaagaggtgccttatctgggcaaacgcgaggaccagtggtgcgggtctttgattggactgacggcccgggctacctgggccactaatatacaggttgcaatcaaccaagtgaggcgactcattggtaatgaaaactaccttgattatatgacatccatgaagagattcaaaaatgagagtgacccagaaggcgctctgtggtga

SEQ ID NO: 13243 - RNA, 9879 nt, synthetic construct
  misc_feature 1..9879: note = derived and/or modified CDS sequence (opt3) from DENV-1__GQ868563__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaaacagatccagagggtggaaacttgggctctgcggcaccctggattcaccgttattgcactgtttctcgcccatgctatcggcacatcgattacccagaagggcatcatattcatcttactgatgcttgtgacgccatcaatggccatgcgctgcgtcgggattggaaacagagattttgtggagggtttgagcggcgcgacttgggtagacgttgtgctggagcacgggagttgtgtcacaaccatggcaaagaataaacccactctagatatcgaactcctgaagacagaggtgaccaaccctgccgtgcttaggaaactgtgcattgaagctaagatctccaatacgaccacagactctcggtgtccaactcaaggagaggccaccttggtcgaagagcaggatgcaaacttcgtttgccgccgaacatttgtggacagaggctggggtaatgggtgtggactcttcggcaaaggcagcctgttaacttgcgctaagtttaagtgcgtaaccaaactggaggggaagatagtgcagtacgaaaacctcaaatattccgtcattgtgacagttcacaccggagatcagcatcaagtgggtaatgagactacggaacacggcacaatcgccaccattactccccaggcgcctacctcagagatccagcttacagactacggggccctgaccttggactgtagtccaaggactggactagatttcaacgaaatggtcctgctcacaatgaaggagaaaagctggctggtgcataagcagtggtttcttgacctgccgttgccctggacgtctggcgcatccacctcacaagagacttggaatcggcaggatctcctggtaacattcaaaaccgctcacgccaagaagcaggaagttgtggtcttaggtagccaagagggggctatgcacacagccctgactggcgcaaccgaaatccagacgagtggaaccacaactatttttgccggccatctaaaatgccgtctcaagatggacaaactgacccttaaggggatgtcttatgtgatgtgtacaggatccttcaaattggagaaggaagtcgctgagactcagcacggtaccgtgctggttcaggtgaagtacgagggcacggatgcgccttgcaaaataccattcagcacacaagacgaaaagggggtaacccagaacggacgcctcatcactgcaaatcccattgtcacagataaagagaagcctgtgaacatcgaaaccgagccaccctttggcgagtcgtatatagttgtgggtgccggggaaaaagctctgaagctttcttggttcaagaaaggctcctcaattggaaagatgtttgaggccactgcaagaggcgccaggcggatggctatcctgggggacaccgcctgggatttcggaagtatcggtggcgtctttacaagcgtggggaaattggtacatcaggtgttcggaacggcatacggcgttctcttttccggtgtctcttggaccatgaagattgggatcggcattctgttaacttggctgggactaaatagccgatcaacaagtctctccatgacctgtatagcggtgggcatggtgacactgtaccttggggtcatggttcaggctgacagcggatgcgtgatcaactggaaaggccgcgaattgaagtgtggttctgggattttcgtgactaacgaggtacacacctggacggaacaatataagtttcaggccgattcaccgaaaagactgagtgcagccatcggaaaggcttgggaggagggcgtctgcggtatcaggagcgccacacggctcgaaaatattatgtggaaacagatatccaacgagctgaatcatatcttactggaaaacgacatgaagttcaccgtggttgtgggcgacgcaaatgggattcttgctcagggaaaaaagatgatccgccctcaacccatggagcacaaatactcttggaagtcgtggggcaaggccaaaattatcggggcggatatacagaacgccacttttatcattgacggaccagatacccctgaatgtcccgacggccagagagcttggaatatctgggaggtcgaggattatggtttcgggatttttacaactaacatctggttgaagctcagggacagctacacccagatgtgcgatcaccgtctgatgtccgcagccataaaagactcaaaggctgtgcatgccgatatgggatattggattgaaagtgagaaaaatgaaacatggaagctagcacgggcgtctttcatcgaggttaagacgtgtacctggccaaaaagccacactctgtggtccaacggcgtgctcgaatcagagatgattatccccaagatatacggtggccctatcagccaacataattatcgaccagggtacttcacacagaccgccggaccgtggcacctgggcaaacttgagttggactttgatctgtgcgaagggactacagtagtcgtggacgagcactgcggaaacagaggcccctctttaaggaccacgactgtgaccggtaagattatccatgaatggtgttgccgctcctgtacactccctccactgcggttcagaggggaggatggatgctggtacggcatggagattaggcccgtcaaagaaaaggaggaaaatcttgttcgcagtatggtgagcgctggttctggcgaggtagactccttttcactggggatcttgtgtgtgagtataatgattgaagaggtcatgcgaagccggtggtcgcgtaagatgctcatgaccggaactctggccgtgttcctactgctcatcatgggccagctgacatggaacgaccttaccagattgtgcatcatggttggggcaaatgcttccgataggatgggaatgggcacaacttatctggccttaatggcaacctttaaaatgcgccctatgttcgccgtgggtctcctgtttcggagacttacgtctagggaggtcctgctactcacaattgggctgagcttggtggcttcagttgaactgccaaacagtttagaggaactcggagacggcctggcgatgggcatcatgatgcttaagctgttgaccgagttccaaccccaccagctctggactaccctgctatccctgacatttgtgaaaactaccctttctctcgattacgcctggaagacgacagcaatggtcctgagcattgtatccttgttcccgctgtgtttatcaaccactagccagaaaacaacctggctccctgtgctgcttgggagttttggatgcaagccactgactatgttcttgataacagaaaacaagatctggggtcgaaaatcttggcccctcaatgagggcattatggctatcgggattgtttccatcctgctaagctcgctgcttaagaacgacgtgcctctcgccggacccctgatagccggcggtatgttgatcgcttgttatgtcatttcagggtctagtgcagatttatccctggagaaagccgcggaagtgagctgggagcaggaagctgagcattctggagccagccacaatatcctcgtagaagtgcaagacgatggcaccatgaagattaaagacgaggagcgcgatgacacgctgactatccttctgaaggcaaccttgctagccgtctccggcgtttacccaatgtcaatacctgctacactgtttgtgtggtatttctggcagaaaaagaagcagcggagtggggtgctctgggatacccccagcccaccggaagtcgagagagcagtgctggacgatggaatttacaggatccttcagcgtggtttactgggccgctctcaagttggggtaggagtgttccaggacggcgtctttcatacaatgtggcacgtgactcggggtgccgttctcatgtatcaggggaaaagattggaaccttcctgggcgtcagtgaagaaagacctgatcagttacggaggcggctggaggttccaggggctctggaacaccggagaggaggtccaagtgattgctgtagaacccggtaagaatccaaaaaacgtccagacgacacccggcacttttaagacccctgagggggaagtgggagccatagcactggatttcaagccaggcacaagcggttcccccatcgttaatcgagaggggaaaattgtgggactttacggcaacggcgtcgtgaccacttctgggacctatgtttcggccatcgctcaggccaaggcaagccaagaaggacctctgccggagattgaggacgaagtgtttaaaaagcggaatttgacaatcatggatctacacccaggttcaggcaaaacgcgcagatacctgcccgctatagtcagggaggccatcaagcggaagctccgaactttaattctggcgcctaccagagtggtagcctccgaaatggcagaggctcttaaagggatgccaatccgctatcagacaaccgccgtgaagagtgaacatactggaagggagattgttgacctgatgtgccacgctacattcaccatgcgtctcttgtctcccgtccgggtgcctaactacaatatgatcataatggatgaggcacattttacggacccggccagcattgccgctagaggctatatctccactagggtgggtatgggggaagcggcagccatcttcatgacagctacccccccaggatcagtcgaggcctttcctcagtctaacgcagtaattcaggatgaagagcgcgacatccccgaacgaagctggaatagtggctacgattggataaccgacttcccaggcaaaactgtgtggtttgttccttccattaagagcgggaacgatatcgccaattgtctgagaaaaaacggaaagcgggtgattcaactctctaggaagacattcgacaccgagtatcagaaaacaaagaacaatgactgggattacgtcgtgactacggacatctcagagatgggtgctaacttccgcgcggatcgtgttatagaccccagacggtgcctgaaaccagtgattcttaaggatggcccggaaagggtcatcctagccgggcctatgcccgtgaccgtagcatccgctgcccagcgccgaggaagaatcggccggaatcagaacaaagagggtgaccaatacgtgtatatggggcagccactgaataacgatgaagaccacgcacattggacagaggccaagatgttgttagataatattaacactcccgagggcatcattcctgctctgtttgaaccagagagggaaaagagtgccgcgatagacggagagtaccgcctcagaggcgaagcaaggaaaaccttcgttgagctgatgcggcgtggggatcttcccgtctggctgagctataaggtggcctcggagggatttcagtactctgaccgccgatggtgcttcgatggtgaaagaaataaccaggtgctcgaggaaaatatggacgtcgagatctggacaaaagaaggcgagaggaagaaattgcggcctcgctggctggacgctagaacctattccgatccgctagccctgagggagtttaaggaattcgctgcagggcggcgaagcgtttcaggagacctcattcttgagatcggcaaactgccacaacacttaactttgagagcccagaacgctctggataatctcgtgatgctgcacaacagtgaacagggtgggaaggcctaccgccatgcaatggaggaacttcccgacacgatcgagaccctgatgctcttggcgctgattgccgtattaacaggcggagtgactctatttttcctgtctggcaaggggctcggaaaaacctccataggtcttctgtgtgtcacagctagctcagccttgctgtggatggcaagtgtggagcctcactggatcgctgccagcattatcctcgaatttttcctgatggttcttctcattcccgagccagataggcagcggacccctcaagacaatcagctggcatatgtggtcatcggcttgctgtttatgatattaactgtagccgctaacgaaatggggctactggagacaacgaagaaagatctcggaatcggctacgcggccgcagagaaccatcagcacgctaccatgcttgacgtggatctgcgtcccgcctccgcctggactttgtacgcagttgctacaaccgtgattaccccaatgatgagacacacaatcgaaaatactacggccaacatttctctgaccgcgatcgctaatcaagccgcaatactcatgggtctggacaaggggtggcctattagcaaaatggatatcggcgtcccgcttttagccctgggatgctattcccaggtgaaccccctcacattgactgctgcagtcctgatgctagtggcccattacgcgattatcggcccagggctgcaggctaaggccaccagggaggcacagaagcgcacagccgctggaataatgaaaaatcctaccgttgacggcatcgtggccattgatctcgaccccgtagtgtatgacgcaaagttcgaaaaacaacttggtcagatcatgctgttgattctgtgtacttcacagatcctcctgatgcggacgacatgggctttatgcgagtctataacccttgccactgggccactgaccacactctgggaaggaagtcctggcaagttttggaacactaccattgcggtctcgatggccaatatcttccgaggtagctacctagcaggcgctgggctggccttctccttgatgaaatctctgggaggcgggagaaggggaacaggcgcacagggtgagacgctcggggagaagtggaagcgccaacttaaccagctgtcaaaaagcgaatttaatacctataagcggtccggaatcatggaggttgatagaagtgaagctaaagagggcttgaagcgtggtgaaactacaaaacacgccgtgtctaggggcaccgccaagctgcggtggttcgtcgagcgcaacctcgtgaagcccgaggggaaagtaattgacttaggatgtggccgagggggatggagctactattgcgcgggcctgaagaaagtgactgaagttaagggttacacaaaagggggaccgggccatgaggaaccaatccctatggctacctacggctggaatcttgtgaagctgcactcagggaaagatgtctttttcatgcccccagagaagtgtgacacgctactctgcgatataggagaatccagtcccaaccctaccattgaggagggtagaacactgagggtgttgaagatggtcgaaccgtggctgcggggcaatcagttttgtatcaaaattctcaacccctatatgccaagcgtggttgagactcttgaacagatgcaacgcaagcatgggggaatgctggtaagaaatcctttatctaggaactccacccacgagatgtactgggtgtcatgcggcacaggtaatatcgtcagcgcagtgaacatgacttcgcgaatgctgttgaaccggttcaccatggcccaccgtaaacccacatatgagagagacgttgatctcggggctggaacccgccatgtggccgtcgaacctgaggtgccaaatctggacataatcggccagaggattgaaaacatcaagaatgagcacaaatctacttggcattacgatgaagacaacccctataagacgtgggcataccacggcagttatgaggtaaagccttccgggagcgcctcatccatggtgaatggagttgtccggctacttacaaaaccatgggatgtgattcccatggtgacccagatcgctatgactgacaccacaccgtttggtcaacagagagtcttcaaggagaaagttgacacgcgcacccctagggcgaagcgaggcactacacagattatggaagtgaccgccaaatggctgtgggggtttctctctcggaacaagaagccaagaatctgtactagggaggaattcacacgcaaagtacgtagcaatgcagctataggagccgtgtttgtcgatgagaaccagtggaatagtgcaaaggaagccgtggaggacgagcggttctgggatctggttcacagagaaagggagttgcataaacaaggcaagtgcgctacctgcgtgtacaacatgatgggtaaacgcgaaaagaagctgggggagtttggaaaagccaagggctcccgagcgatttggtacatgtggctcggcgcacggttccttgaattcgaggccctggggtttatgaatgaggaccactggttcagcagagaaaactctttatcaggagtcgagggtgaaggcctgcataaattggggtatatcctcagggatatcagtaagattcccggaggcaatatgtacgctgacgatacagccggttgggacactcgcataaccgaggatgacctgcagaacgaggcaaaaatcacggatattatggaacctgagcacgctctacttgccacctccatctttaagctgacatatcagaataaagtggtaagagttcagcggccagctaagaacgggactgtgatggacgtcattagcaggcgtgatcaacgaggatctggccaggtgggcacctacgggctcaacacattcactaatatggaagtgcagctgatccgccagatggagtcggaaggaatatttttgccctcagagttagagaccccgaacctggccgaaagagtcctcgactggcttgagaagcatggtgcagaacggctgaaaaggatggcgatcagcggcgacgattgtgttgtgaagcctattgacgatcgcttcgccacggctctaacagccctgaatgacatggggaaagtaagaaaggatatcccccaatgggagccatccaaaggatggaacgactggcagcaggtgcctttttgcagtcaccacttccatcagctcattatgaaggatggccgggaaatcgtcgtgccctgtaggaatcaagacgagttggttggtcgagcacgtgtgtctcagggggctggatggagcctgagagagaccgcctgccttggcaagtcctatgcacagatgtggcaactgatgtactttcaccgccgggatctcaggttagccgcgaacgctatatgttcagccgtcccagtggaatgggtacccactagtagaacaacctggtctattcatgcacaccaccagtggatgactaccgaggacatgctgagcgtttggaatcgcgtgtggatcgaagagaacccttggatggaagataaaacacatgtctcctcatgggaggaggtgccatatttgggcaagcgggaagaccagtggtgcgggagcctgatcggactcacggccagggctacctgggccactaatattcaggttgcaataaaccaagtgcgaagacttatcggtaatgagaactacctggactacatgacatctatgaaacggttcaagaatgaatccgatccggagggcgctctatggtga

SEQ ID NO: 13244 - RNA, 9879 nt, synthetic construct
  misc_feature 1..9879: note = derived and/or modified CDS sequence (opt3) from DENV-1__GQ868564__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaagcactgctatttaagacctctgccggtgttaacatgtgcacactcattgcgatggacctgggcgagctttgtgaagatactatgacctacaaatgcccacggataacagaggctgaaccggacgatgtggactgttggtgcaatgccaccgatacttgggtaacatatgggacctgttcacaaacgggagagcaccgccgagacaagcgtagtgtggcactggccccccatgtcggcttgggtctcgagactagaaccgaaacatggatgagctccgagggggcttggaaacagatccagagggtggaaacttgggcactgcggcaccctggattcaccgttattgccctgtttctcgctcatgccatcggcacatctattacccagaagggcatcatattcatcttactgatgcttgtgacgccatcgatggcgatgcgctgcgtcgggattggaaacagagattttgtggagggtttgtcaggcgcaacttgggtagacgttgtgctggagcacgggagctgtgtcacaaccatggccaagaataaacccactctagatatcgaactcctgaagacagaggtgaccaaccctgctgtgcttaggaaactgtgcattgaagccaagatcagtaatacgaccacagactcccggtgtccaactcaaggagaggcaaccttggtcgaagagcaggatgctaacttcgtttgccgccgaacatttgtggacagaggctggggtaatgggtgtggactcttcggcaaaggctctctgttaacttgcgccaagtttaagtgcgtaaccaaactggaggggaagatagtgcagtacgaaaacctcaaatatagcgtcattgtgacagttcacaccggagatcagcatcaagtgggtaatgagactacggaacacggcacaatcgcgaccattactccccaggcccctacctccgagatccagcttacagactacggggcactgaccttggactgttcaccaaggactggactagatttcaacgaaatggtcctgctcacaatgaaggagaaaagttggctggtgcataagcagtggtttcttgacctgccgttgccctggacgagcggcgcttctacctcccaagagacttggaatcggcaggatctcctggtaacattcaaaaccgcccacgctaagaagcaggaagttgtggtcttaggttcacaagagggggccatgcacacagcactgactggcgccaccgaaatccagacgagcggaaccacaactatttttgctggccatctaaaatgccgtctcaagatggacaaactgacccttaaggggatgagttatgtgatgtgtacaggatctttcaaattggagaaggaagtcgcggagactcagcacggtaccgtgctggttcaggtgaagtacgagggcacggatgcaccttgcaaaataccattctccacacaagacgaaaagggggtaacccagaacggacgcctcatcactgccaatcccattgtcacagataaagagaagcctgtgaacatcgaaaccgagccaccctttggcgagagctatatagttgtgggtgctggggaaaaagccctgaagctttcgtggttcaagaaaggctcttccattggaaagatgtttgaggcaactgccagaggcgctaggcggatggccatcctgggggacaccgcatgggatttcggatcaatcggtggcgtctttacaagtgtggggaaattggtacatcaggtgttcggaacggcgtacggcgttctctttagcggtgtctcctggaccatgaagattgggatcggcattctgttaacttggctgggactaaattctcgaagcacatcactcagtatgacctgtatagctgtgggcatggtgacactgtaccttggggtcatggttcaggccgactccggatgcgtgatcaactggaaaggccgcgaattgaagtgtggtagcgggattttcgtgactaacgaggtacacacctggacggaacaatataagtttcaggcagattctccgaaaagactgtcagccgctatcggaaaggcctgggaggagggcgtctgcggtatcaggagtgcaacacggctcgaaaatattatgtggaaacagataagcaacgagctgaatcatatcttactggaaaacgacatgaagttcaccgtggttgtgggcgacgctaatgggattcttgcccagggaaaaaagatgatccgccctcaacccatggagcacaaatactcctggaagtcttggggcaaggcgaaaattatcggggccgatatacagaacactacctttatcattgacggaccagatacacctgaatgtcccgacggccagagagcttggaatatctgggaggtcgaggattatggtttcgggatttttactaccaacatctggttgaagctcagggactcgtacacacagatgtgcgatcaccgtctgatgagcgcagccataaaagactccaaggctgtgcatgccgatatgggatattggattgaatcagagaaaaatgaaacgtggaagctagcacgggcgagtttcatcgaggttaagacctgtacttggccaaaatctcacacactgtggagcaacggcgtgctcgaatccgagatgattatccccaagatatacggtggccctatctcacaacataattatcgaccagggtacttcacccagactgccggaccgtggcacctgggcaaacttgagttggactttgatctgtgcgaagggacaaccgtagtcgtggacgagcactgcggaaacagaggccccagcttaaggacgactaccgtgacaggtaagattatccatgaatggtgttgccgctcttgtaccctccctccactgcggttcagaggggaggatggatgctggtacggcatggagattaggcccgtcaaagaacgcgaggaaaatcttgttcgatccatggtgagtgctggtagcggcgaggtagactctttttccctggggatcttgtgtgtgtcaataatgattgaagaggtcatgcggagtcgttggagcagaaagatgctcatgactggaacactggccgtgttcctactgctcatcatgggccagctgacctggaacgaccttacaaggttgtgcatcatggttggggcaaatgcttcggatcgcatgggaatgggcactacctatctggccttaatggcaacgtttaagatgcggcctatgttcgccgtgggtctcctgtttagaaggcttacatcccgagaggtcctgctactcaccattgggctgtctttggtggctagcgttgaactgccaaactcattagaggaactcggagacggcctggcgatgggcatcatgatgcttaaactgttgactgagttccaaccccaccagctctggaccacactgctaagtctgacttttgtgaagaccacgctttccctcgattacgcctggaaaacaaccgcaatggtcctgtctattgtaagcttgttcccgctgtgtttatccactacatcacagaagaccacttggctccctgtgctgcttgggagctttggatgcaaaccactgacaatgttcttgataaccgaaaacaagatctggggtcgcaagagttggcccctcaatgagggcattatggctatcgggattgtttctatcctgctatccagcctgcttaaaaacgacgtgcctctcgccggacccctgatagccggcggtatgttgatcgcttgttatgtcatttcggggtcatctgcagatttaagtctggagaaggccgcggaagtgtcctgggagcatgaagctgagcacagcggagcctctcataatatcctcgtagaagtgcaggacgatggcacgatgaaaattaaggacgaggagcgggatgacactctgaccatccttctgaaagcagccttgctagctgtcagcggcgtttacccaatgtccatacctgcaacactgtttgtgtggtatttctggcaaaagaaaaagcagagatcaggggtgctctgggatacccccagtccaccggaagtcgagagggccgtgctggacgatggaatttaccgtatccttcagcgcggtttactgggccggagccaggttggggtaggagtgttccaagacggcgtctttcacacaatgtggcacgtgactagaggtgcggttctcatgtatcaggggaagaggttggaaccttcttgggcttccgtgaaaaaggacctgatctcatacggaggcggctggcgattccaggggagttggaacaccggagaggaggtccaggtgattgccgtagaacccggtaaaaatccaaagaacgtccaaacgacacccggcacttttaaaacccctgagggggaagtgggagcaatagccctcgatttcaagccaggcacaagcggttcccccatcgttaatcgggaggggaagattgtgggactgtacggcaacggcgtcgtgaccacttctgggacctatgtttcggctatcgcccaggcaaaagctagccaggaaggacctcttccggagattgaggacgaagtgtttaagaaacgcaatctgacaatcatggatttgcatccaggttcaggcaagacgagaaggtacctacccgccatagtccgggaggcgatcaaacgaaagctgagaactctcattttagcccctacccgcgtggtagcatccgaaatggctgaggccctgaaggggatgccaatcaggtatcaaacaaccgctgtgaaaagtgaacacactggacgtgagattgttgaccttatgtgccatgcaacattcaccatgcggctgctctctcccgtcagagtgcctaactacaatatgatcataatggatgaggcccactttacggacccggccagcattgctgcgaggggctatatctccactcgcgtgggtatgggggaagcagccgctatcttcatgacagccacccccccaggatcagtcgaggcatttcctcagtctaacgccgtaattcaggatgaagagcgagacatccccgaaagaagctggaatagtggctacgattggataaccgacttcccaggcaagactgtgtggtttgttccttccattaaaagcgggaacgatatcgctaattgtttgcggaagaacggaaaaagggtgattcagctgtctcgcaagacattcgacaccgagtatcaaaagacaaaaaacaatgactgggattacgtcgtgactacggacatctcagagatgggtgcgaacttccgtgccgatagagttatagacccccggaggtgcctcaagccagtgattctgaaagatggcccggaacgcgtcatccttgcagggcctatgcccgtgaccgtagcttccgccgcacagcgaagaggacggatcggcaggaatcagaacaaggagggtgaccagtacgtgtatatggggcaaccactaaataacgatgaagaccatgcccactggacagaggctaaaatgctgttggataatattaacactcccgagggcatcattcctgccttatttgaaccagagcgcgaaaagagtgcggcaatagacggagagtacagactgaggggcgaagcccggaagaccttcgttgagctcatgcgtcgcggggatctgcccgtctggcttagctataaagtggcttcggagggatttcagtactctgaccgaagatggtgcttcgatggtgaaaggaataaccaggtgctggaggaaaatatggacgtcgagatctggacaaaggaaggcgagcggaaaaagctccgccctagatggttggacgccaggacctattccgatccgctggctctacgggagtttaaagaattcgcagccgggcgaagaagcgtttcaggagacctgattctcgagatcggcaagcttccacagcacctgactttacgcgctcaaaacgccttggataatctggtgatgctccataacagtgaacagggtgggaaagcatacaggcacgcgatggaggaactgcccgacacgatcgagacccttatgctgctcgccttgattgctgtactgacaggcggagtgactttatttttcctatctggcaaggggctgggaaagacctccataggtctcctttgtgtcacagccagctcagcactgttgtggatggctagtgtggagcctcattggatcgccgcaagcattatcctggaatttttcctcatggttctgcttattcccgagccagatcggcagcgtacccctcaggacaatcaactcgcctatgtggtcatcggcctgttgtttatgatactgactgtagctgcgaacgaaatggggttactagagacaacgaaaaaggatctgggaatcggccacgtggccgcagagaaccaccagcatgctaccatgctcgacgttgatcttagacccgcctccgcctggactctgtacgcagtggctacaaccgtcattaccccaatgatgaggcacacaatcgaaaatactacggccaacatttctttgaccgcgatcgctaatcaggccgcaatactgatgggtctcgacaaagggtggcctattagcaagatggatatcggcgtgccgctgcttgccttaggatgctactcccaagtcaaccccctgacactcactgctgcagtgttgatgctggttgcccattatgcgattatcggcccagggctacaggctaaagccacccgcgaggcacagaagcggacagccgctggaataatgaagaatcctaccgtggacggcatcgtagccattgatctggaccccgtggtctacgacgcaaaattcgaaaagcagctcggtcaaatcatgcttctgattttgtgtacttcacagatcctgctcatgcgaacgacatgggctctgtgcgagtctataaccttagccactgggccacttaccacactgtgggaaggaagtcctggcaaattttggaacactaccattgcggtttcgatggccaatatcttcagaggtagctatctcgcaggcgctgggctagccttctccctgatgaagtctttgggaggcgggaggcgcggaacaggcgcacagggtgagacgctgggggagaaatggaagcggcagctcaaccaactttcaaagagcgaatttaatacctacaaaagatccggaatcatggaggtggatcgtagtgaagctaaggagggcctgaaaaggggtgaaactacaaagcacgccgtctctcggggcaccgccaaattgcgctggttcgtggagcgaaacctggtaaagcccgaggggaaggtgattgacctcggatgtggcagagggggatggagctattactgcgcgggcttaaaaaaggttactgaagtgaaaggttatacaaaggggggaccgggccatgaggaaccaatccctatggctacctacggctggaatctggtcaaacttcactcagggaaggatgtgtttttcatgcccccagagaaatgtgacacgctgctatgcgatataggagaatccagtcccaaccctaccattgaggagggtaggacactccgggtcctgaagatggtggaaccgtggttgcgcggcaatcagttttgtatcaagattctgaacccctacatgccaagcgttgtagagactctcgaacagatgcagagaaaacacgggggaatgcttgtgaggaatcctctgtctcgaaactccacccatgagatgtattgggtctcatgcggcacaggtaatatcgtgagcgcagttaacatgacttcgcggatgttactgaaccgtttcaccatggcccacagaaagcccacatacgagcgcgacgtggatttgggggctggaaccaggcatgtcgccgtggaacctgaggtagcaaatctcgacataatcggccaacggattgaaaacatcaaaaatgagcacaagtctacttggcactatgatgaagacaacccatacaaaacgtgggcctatcatggcagttacgaggtgaagccctccgggagcgcttcatccatggttaatggagtcgtgagactgctaacaaagccttgggatgtgattccaatggtcacccagatcgcgatgactgacaccacaccctttggtcagcaacgcgttttcaaagagaaggtggacacgaggaccccgcgagccaaacggggcactacacagattatggaagtaaccgcaaagtggctttgggggtttctgtctagaaacaaaaagcctaggatctgtactcgcgaggaattcacacgtaaggtgcggagcaatgctgccataggagcagtctttgtggatgagaaccagtggaatagtgccaaagaagctgttgaggacgagagattctgggatctcgtgcacagggaacgcgagctgcataagcagggcaaatgcgccacctgcgtctataacatgatgggtaagcgagaaaaaaagttgggggagtttggaaaggcgaaaggctcccgggcaatttggtacatgtggctgggcgccagattcctcgaattcgaggctcttgggtttatgaatgaggaccactggttcagcagggaaaactctctgtcaggagtggagggtgaaggcttacataagctggggtacatcttgcgcgatatcagtaaaattccaggaggcaatatgtatgccgacgatacagcaggttgggacactagaataaccgaggatgacctccaaaacgaggctaagatcacggatattatggaacccgagcacgccctgctagctacctccatctttaaacttacataccagaataaggtagttcgggtgcagaggcctgccaaaaacgggactgtcatggacgtgattagccgtcgagatcagcgcggatctggccaagtgggcacctatgggctgaacacattcactaatatggaagtccagctcatcagacagatggagtcggaaggaatatttctgccatcagagttggagacccccaacttagcagaacgggttctggactggctcgagaagcacggtgcggaaaggcttaagcgcatggccatcagcggcgacgattgtgtggtaaaaccgattgacgatagattcgctacggccctgacagcactaaatgacatggggaaggtgcggaaagatatccctcagtgggagccctccaagggatggaacgactggcaacaggtcccattttgcagtcatcacttccatcagctgattatgaaagatggcagggaaatcgtggttccttgtcgaaatcaggacgagctcgtgggtcgtgctagagtctctcaaggggccggatggagcttgcgcgagaccgcatgcctgggcaagtcctacgcccagatgtggcagcttatgtattttcaccggagggatctgagactcgcggctaacgccatatgttcagcagtgcccgtagaatgggttccaactagtcgcacaacctggtctattcacgcccatcaccaatggatgactaccgaggacatgttaagcgtgtggaatcgggtctggatcgaagagaacccctggatggaagataagacacatgtgtcctcatgggaggaggttccttacctgggcaaaagggaagaccagtggtgcgggagcttgatcggactgacggctcgagccacctgggcaactaatattcaggtggctataaaccaggtcagacggctcatcggtaatgagaactatcttgactacatgacatctatgaagaggttcaaaaatgaatccgatccagagggcgccctgtggtga

SEQ ID NO: 13245 - RNA, 9879 nt, synthetic construct
  misc_feature 1..9879: note = derived and/or modified CDS sequence (opt3) from DENV-1__GQ868565__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaaacagatccagagggtggaaacttgggctctgcggcaccctggattcaccgttattgcactgtttctcgcccatgctatcggcacatcgattacccagaagggcatcatattcatcttactgatgcttgtgacgccatcaatggccatgcgctgcgtcgggattggaaacagagattttgtggagggtttgagcggcgcgacttgggtagacgttgtgctggagcacgggagttgtgtcacaaccatggcaaagaataaacccactctagatatcgaactcctgaagacagaggtgaccaaccctgccgtgcttaggaaactgtgcattgaagctaagatctccaatacgaccacagactctcggtgtccaactcaaggagaggccaccttggtcgaagagcaggatgcaaacttcgtttgccgccgaacatttgtggacagaggctggggtaatgggtgtggactcttcggcaaaggcagcctgttaacttgcgctaagtttaagtgcgtaaccaaactggaggggaagatagtgcagtacgaaaacctcaaatattccgtcattgtgacagttcacaccggagatcagcatcaagtgggtaatgagactacggaacacggcacaatcgccaccattactccccaggcgcctacctcagagatccagcttacagactacggggccctgaccttggactgtagtccaaggactggactagatttcaacgaaatggtcctgctcacaatgaaggagaaaagctggctggtgcataagcagtggtttcttgacctgccgttgccctggacgtctggcgcatccacctcacaagagacttggaatcggcaggatctcctggtaacattcaaaaccgctcacgccaagaagcaggaagttgtggtcttaggtagccaagagggggctatgcacacagccctgactggcgcaaccgaaatccagacgagtggaaccacaactatttttgccggccatctaaaatgccgtctcaagatggacaaactgacccttaaggggatgtcttatgtgatgtgtacaggatccttcaaattggagaaggaagtcgctgagactcagcacggtaccgtgctggttcaggtgaagtacgagggcacggatgcgccttgcaaaataccattcagcacacaagacgaaaagggggtaacccagaacggacgcctcatcactgcaaatcccattgtcacagataaagagaagcctgtgaacatcgaaaccgagccaccctttggcgagtcgtatatagttgtgggtgccggggaaaaagctctgaagctttcttggttcaagaaaggctcctcaattggaaagatgtttgaggccactgcaagaggcgccaggcggatggctatcctgggggacaccgcctgggatttcggaagtatcggtggcgtctttacaagcgtggggaaattggtacatcaggtgttcggaacggcatacggcgttctcttttccggtgtctcttggaccatgaagattgggatcggcattctgttaacttggctgggactaaatagccgatcaacaagtctctccatgacctgtatagcggtgggcatggtgacactgtaccttggggtcatggttcaggctgacagcggatgcgtgatcaactggaaaggccgcgaattgaagtgtggttctgggattttcgtgactaacgaggtacacacctggacggaacaatataagtttcaggccgattcaccgaaaagactgagtgcagccatcggaaaggcttgggaggagggcgtctgcggtatcaggagcgccacacggctcgaaaatattatgtggaaacagatatccaacgagctgaatcatatcttactggaaaacgacatgaagttcaccgtggttgtgggcgacgcaaatgggattcttgctcagggaaaaaagatgatccgccctcaacccatggagcacaaatactcttggaagtcgtggggcaaggccaaaattatcggggcggatatacagaacgccacttttatcattgacggaccagatacccctgaatgtcccgacggccagagagcttggaatatctgggaggtcgaggattatggtttcgggatttttacaactaacatctggttgaagctcagggacagctacacccagatgtgcgatcaccgtctgatgtccgcagccataaaagactcaaaggctgtgcatgccgatatgggatattggattgaaagtgagaaaaatgaaacatggaagctagcacgggcgtctttcatcgaggttaagacgtgtacctggccaaaaagccacactctgtggtccaacggcgtgctcgaatcagagatgattatccccaagatatacggtggccctatcagccaacataattatcgaccagggtacttcacacagaccgccggaccgtggcacctgggcaaacttgagttggactttgatctgtgcgaagggactacagtagtcgtggacgagcactgcggaaacagaggcccctctttaaggaccacgactgtgaccggtaagattatccatgaatggtgttgccgctcctgtacactccctccactgcggttcagaggggaggatggatgctggtacggcatggagattaggcccgtcaaagaaaaggaggaaaatcttgttcgcagtatggtgagcgctggttctggcgaggtagactccttttcactggggatcttgtgtgtgagtataatgattgaagaggtcatgcgaagccggtggtcgcgtaagatgctcatgaccggaactctggccgtgttcctactgctcatcatgggccagctgacatggaacgaccttaccagattgtgcatcatggttggggcaaatgcttccgataggatgggaatgggcacaacttatctggccttaatggcaacctttaaaatgcgccctatgttcgccgtgggtctcctgtttcggagacttacgtctagggaggtcctgctactcacaattgggctgagcttggtggcttcagttgaactgccaaacagtttagaggaactcggagacggcctggcgatgggcatcatgatgcttaagctgttgaccgagttccaaccccaccagctctggactaccctgctatccctgacatttgtgaaaactaccctttctctcgattacgcctggaagacgacagcaatggtcctgagcattgtatccttgttcccgctgtgtttatcaaccactagccagaaaacaacctggctccctgtgctgcttgggagttttggatgcaagccactgactatgttcttgataacagaaaacaagatctggggtcgaaaatcttggcccctcaatgagggcattatggctatcgggattgtttccatcctgctaagctcgctgcttaagaacgacgtgcctctcgccggacccctgatagccggcggtatgttgatcgcttgttatgtcatttcagggtctagtgcagatttatccctggagaaagccgcggaagtgagctgggagcaggaagctgagcattctggagccagccacaatatcctcgtagaagtgcaagacgatggcaccatgaagattaaagacgaggagcgcgatgacacgctgactatccttctgaaggcaaccttgctagccgtctccggcgtttacccaatgtcaatacctgctacactgtttgtgtggtatttctggcagaaaaagaagcagcggagtggggtgctctgggatacccccagcccaccggaagtcgagagagcagtgctggacgatggaatttacaggatccttcagcgtggtttactgggccgctctcaagttggggtaggagtgttccaggacggcgtctttcatacaatgtggcacgtgactcggggtgccgttctcatgtatcaggggaaaagattggaaccttcctgggcgtcagtgaagaaagacctgatcagttacggaggcggctggaggttccaggggctctggaacaccggagaggaggtccaagtgattgctgtagaacccggtaagaatccaaaaaacgtccagacgacacccggcacttttaagacccctgagggggaagtgggagccatagcactggatttcaagccaggcacaagcggttcccccatcgttaatcgagaggggaaaattgtgggactttacggcaacggcgtcgtgaccacttctgggacctatgtttcggccatcgctcaggccaaggcaagccaagaaggacctctgccggagattgaggacgaagtgtttaaaaagcggaatttgacaatcatggatctacacccaggttcaggcaaaacgcgcagatacctgcccgctatagtcagggaggccatcaagcggaagctccgaactttaattctggcgcctaccagagtggtagcctccgaaatggcagaggctcttaaagggatgccaatccgctatcagacaaccgccgtgaagagtgaacatactggaagggagattgttgacctgatgtgccacgctacattcaccatgcgtctcttgtctcccgtccgggtgcctaactacaatatgatcataatggatgaggcacattttacggacccggccagcattgccgctagaggctatatctccactagggtgggtatgggggaagcggcagccatcttcatgacagctacccccccaggatcagtcgaggcctttcctcagtctaacgcagtaattcaggatgaagagcgcgacatccccgaacgaagctggaatagtggctacgattggataaccgacttcccaggcaaaactgtgtggtttgttccttccattaagagcgggaacgatatcgccaattgtctgagaaaaaacggaaagcgggtgattcaactctctaggaagacattcgacaccgagtatcagaaaacaaagaacaatgactgggattacgtcgtgactacggacatctcagagatgggtgctaacttccgcgcggatcgtgttatagaccccagacggtgcctgaaaccagtgattcttaaggatggcccggaaagggtcatcctagccgggcctatgcccgtgaccgtagcatccgctgcccagcgccgaggaagaatcggccggaatcagaacaaagagggtgaccaatacgtgtatatggggcagccactgaataacgatgaagaccacgcacattggacagaggccaagatgttgttagataatattaacactcccgagggcatcattcctgctctgtttgaaccagagagggaaaagagtgccgcgatagacggagagtaccgcctcagaggcgaagcaaggaaaaccttcgttgagctgatgcggcgtggggatcttcccgtctggctgagctataaggtggcctcggagggatttcagtactctgaccgccgatggtgcttcgatggtgaaagaaataaccaggtgctcgaggaaaatatggacgtcgagatctggacaaaagaaggcgagaggaagaaattgcggcctcgctggctggacgctagaacctattccgatccgctagccctgagggagtttaaggaattcgctgcagggcggcgaagcgtttcaggagacctcattcttgagatcggcaaactgccacaacacttaactttgagagcccagaacgctctggataatctcgtgatgctgcacaacagtgaacagggtgggaaggcctaccgccatgcaatggaggaacttcccgacacgatcgagaccctgatgctcttggcgctgattgccgtattaacaggcggagtgactctatttttcctgtctggcaaggggctcggaaaaacctccataggtcttctgtgtgtcacagctagctcagccttgctgtggatggcaagtgtggagcctcactggatcgctgccagcattatcctcgaatttttcctgatggttcttctcattcccgagccagataggcagcggacccctcaagacaatcagctggcatatgtggtcatcggcttgctgtttatgatattaactgtagccgctaacgaaatggggctactggagacaacgaagaaagatctcggaatcggctacgcggccgcagagaaccatcagcacgctaccatgcttgacgtggatctgcgtcccgcctccgcctggactttgtacgcagttgctacaaccgtgattaccccaatgatgagacacacaatcgaaaatactacggccaacatttctctgaccgcgatcgctaatcaagccgcaatactcatgggtctggacaaggggtggcctattagcaaaatggatatcggcgtcccgcttttagccctgggatgctattcccaggtgaaccccctcacattgactgctgcagtcctgatgctagtggcccattacgcgattatcggcccagggctgcaggctaaggccaccagggaggcacagaagcgcacagccgctggaataatgaaaaatcctaccgttgacggcatcgtggccattgatctcgaccccgtagtgtatgacgcaaagttcgaaaaacaacttggtcagatcatgctgttgattctgtgtacttcacagatcctcctgatgcggacgacatgggctttatgcgagtctataacccttgccactgggccactgaccacactctgggaaggaagtcctggcaagttttggaacactaccattgcggtctcgatggccaatatcttccgaggtagctacctagcaggcgctgggctggccttctccttgatgaaatctctgggaggcgggagaaggggaacaggcgcacagggtgagacgctcggggagaagtggaagcgccaacttaaccagctgtcaaaaagcgaatttaatacctataagcggtccggaatcatggaggttgatagaagtgaagctaaagagggcttgaagcgtggtgaaactacaaaacacgccgtgtctaggggcaccgccaagctgcggtggttcgtcgagcgcaacctcgtgaagcccgaggggaaagtaattgacttaggatgtggccgagggggatggagctactattgcgcgggcctgaagaaagtgactgaagttaagggttacacaaaagggggaccgggccatgaggaaccaatccctatggctacctacggctggaatcttgtgaagctgcactcagggaaagatgtctttttcatgcccccagagaagtgtgacacgctactctgcgatataggagaatccagtcccaaccctaccattgaggagggtagaacactgagggtgttgaagatggtcgaaccgtggctgcggggcaatcagttttgtatcaaaattctcaacccctatatgccaagcgtggttgagactcttgaacagatgcaacgcaagcatgggggaatgctggtaagaaatcctttatctaggaactccacccacgagatgtactgggtgtcatgcggcacaggtaatatcgtcagcgcagtgaacatgacttcgcgaatgctgttgaaccggttcaccatggcccaccgtaaacccacatatgagagagacgttgatctcggggctggaacccgccatgtggccgtcgaacctgaggtggcaaatctggacataatcggccagaggattgaaaacatcaagaatgagcacaaatctacttggcattacgatgaagacaacccatataagacgtgggcctaccacggcagttatgaggtaaagccctccgggagcgcttcatccatggtgaatggagttgtccggctacttacaaaaccttgggatgtgattccaatggtgacccagatcgcgatgactgacaccacaccctttggtcaacagagagtcttcaaggagaaagttgacacgcgcaccccgagggccaagcgaggcactacacagattatggaagtgaccgcaaaatggctgtgggggtttctctctcggaacaagaagcctagaatctgtactagggaggaattcacacgcaaagtacgtagcaatgctgccataggagcagtgtttgtcgatgagaaccagtggaatagtgccaaggaagctgtggaggacgagcggttctgggatctggttcacagagaaagggagttgcataaacaaggcaagtgcgccacctgcgtgtacaacatgatgggtaaacgcgaaaagaagctgggggagtttggaaaagcgaagggctcccgagcaatttggtacatgtggctcggcgcccggttccttgaattcgaggctctggggtttatgaatgaggaccactggttcagcagagaaaactctttatcaggagtcgagggtgaaggcctgcataaattggggtatatcctcagggatatcagtaagattccaggaggcaatatgtacgccgacgatacagcaggttgggacactcgcataaccgaggatgacctgcagaacgaggctaaaatcacggatattatggaacccgagcacgccctacttgctacctccatctttaagctgacatatcagaataaagtggtaagagttcagcggcctgccaagaacgggactgtgatggacgtcattagcaggcgtgatcaacgaggatctggccaggtgggcacctacgggctcaacacattcactaatatggaagtgcagctgatccgccagatggagtcggaaggaatatttttgccatcagagttagagacccccaacctggcagaaagagtcctcgactggcttgagaagcatggtgcggaacggctgaaaaggatggccatcagcggcgacgattgtgttgtgaagccgattgacgatcgcttcgctacggccctaacagcactgaatgacatggggaaagtaagaaaggatatccctcaatgggagccctccaaaggatggaacgactggcagcaggtgccattttgcagtcaccacttccatcagctcattatgaaggatggccgggaaatcgtcgtgccttgtaggaatcaagacgagttggttggtcgagctcgtgtgtctcagggggccggatggagcctgagagagaccgcatgccttggcaagtcctatgcccagatgtggcaactgatgtactttcaccgccgggatctcaggttagcggctaacgccatatgttcagcagtccccgtggaatgggtaccaactagtagaacaacctggtctattcatgcccaccaccagtggatgactaccgaggacatgctgagcgtttggaatcgcgtgtggatcgaagagaacccctggatggaagataaaacacatgtctcctcatgggaggaggtgccttatttgggcaagcgggaagaccagtggtgcgggagcctgatcggactcacggctagggccacctgggcaactaatattcaggttgctataaaccaagtgcgaagacttatcggtaatgagaactacctggactacatgacatctatgaaacggttcaagaatgaatccgatccagagggcgccctatggtga

SEQ ID NO: 13246 - RNA, 9879 nt, synthetic construct
  misc_feature 1..9879: note = derived and/or modified CDS sequence (opt3) from DENV-1__GQ868568__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaaacagatccagagggtggaaacttgggctctgcggcaccctggattcaccgttattgcactgtttctcgcccatgtgatcggcacatcgattacccagaagggcatcatattcatcttactgatgcttgtcacgccatcaatggctatgcgctgcgtggggattggaaacagagattttgtagagggtttgagcggcgccacttgggttgacgtggtcctggagcacgggagttgtgtgacaaccatggcgaagaataaacccactctagatatcgaactcctgaagacagaggtgaccaaccctgcagtccttaggaaactgtgcattgaagccaagatctccaatacgaccacagactctcggtgtccaactcaaggagaggctaccttggttgaagagcaggatgccaacttcgtgtgccgccgaacatttgtagacagaggctggggtaatgggtgtggactcttcggcaaaggcagcctgttaacttgcgcaaagtttaagtgcgtgaccaaactggaggggaagatagtccagtacgaaaacctcaaatattccgtgattgttacagtgcacaccggagatcagcatcaagtcggtaatgagactacggaacacggcacaatcgctaccattactccccaggcccctacctcagagatccagcttacagactacggggcgctgaccttggactgtagtccaaggactggactagatttcaacgaaatggtgctgctcacaatgaaggagaaaagctggctggtacataagcagtggtttcttgacctgccgttgccctggacgtctggcgcctccacctcacaagagacttggaatcggcaggatctcctggttacattcaaaaccgcacacgctaagaagcaggaagtggtcgtgttaggtagccaagagggggccatgcacacagctctgactggcgccaccgaaatccagacgagtggaaccacaactatttttgcaggccatctaaaatgccgtctcaagatggacaaactgacccttaaggggatgtcttatgtcatgtgtacaggatccttcaaattggagaaggaagtggccgagactcagcacggtaccgttctggtgcaggtaaagtacgagggcacggatgctccttgcaaaataccattcagcacacaagacgaaaagggggtcacccagaacggacgcctcatcactgcgaatcccattgtgacagataaagagaagcctgttaacatcgaaaccgagccaccctttggcgagtcgtatatagtggtcggtgcaggggaaaaagccctgaagctttcttggttcaagaaaggctcctcaattggaaagatgtttgaggctactgccagaggcgcaaggcggatggccatcctgggggacaccgcttgggatttcggaagtatcggtggcgtgtttacaagcgtagggaaattggtgcatcaggttttcggaacggcctacggcgtcctcttttccggtgtgtcttggattatgaagatcgggattggcatactgttaacctggctgggactaaatagccgatcaactagtctctccatgacatgtatcgcagtgggcatggtcaccctgtaccttggggttatggtgcaggcggacagcggatgcgtgattaactggaaaggccgcgaattgaagtgtggttctgggatcttcgtaacaaacgaggtccacacttggaccgaacaatataagtttcaggctgattcaccgaaaagactgagtgccgcaatcggaaaggcctgggaggagggcgtgtgcggtattaggagcgctacgcggctcgaaaatataatgtggaaacagatctccaacgagctgaatcatattttactggaaaacgacatgaagttcacagttgtggtcggcgacgccaatgggatccttgcacagggaaaaaagatgattcgccctcaacccatggagcacaaatactcttggaagtcgtggggcaaggctaaaatcataggggccgatacccagaacactacctttatcattgacggaccagatacacctgaatgtcccgacggccagagagcgtggaatatctgggaggtggaggattatggtttcgggatttttactaccaacatctggttgaagctcagggacagctacacacagatgtgcgatcaccgtctgatgtccgccgctataaaagactcaaaggcagttcatgccgatatgggatattggattgaaagtgagaaaaatgaaacgtggaagctagctcgggcctctttcatcgaggtgaagacctgtacttggccaaaaagccacacactgtggtccaacggcgtactcgaatcagagatgattatccccaagatatacggtggccctatcagccaacataattatcgaccagggtacttcacccagactgcaggaccgtggcacctgggcaaacttgagttggactttgatctgtgcgaagggacaaccgtcgtggtggacgagcactgcggaaacagaggcccctctttaaggacgactaccgtcacaggtaagattatccatgaatggtgttgccgctcctgtaccctccctccactgcggttcagaggggaggatggatgctggtacggcatggagattaggcccgttaaagaaaaggaggaaaatcttgtgcgcagtatggtaagcgcgggttctggcgaggtggactccttttcactggggatcttgtgtgtcagtataatgattgaagaggtgatgcgaagccggtggtcgcgtaagatgctcatgactggaacactggccgttttcctactgctcatcatgggccagctgacctggaacgaccttacaagattgtgcatcatggtgggggctaatgcctccgataggatgggaatgggcactacctatctggcattaatggctacgtttaaaatgcgccctatgttcgccgtcggtctcctgtttcggagacttacatctagggaggtgctgctactcaccattgggctgagcttggttgcatcagtggaactgccaaacagtttagaggaactcggagacggcctggccatgggcatcatgatgcttaagctgttgactgagttccaaccccaccagctctggaccacactgctatccctgacttttgtcaaaaccacgctttctctcgattacgcttggaagacaaccgcgatggtactgagcattgtgtccttgttcccgctgtgtttatcaactacaagccagaaaaccacttggctccctgttctgcttgggagttttggatgcaagccactgacaatgttcttgataaccgaaaacaagatctggggtcgaaaatcttggcccctcaatgagggcattatggccatcgggattgtgtccatcctgctaagctcgctgcttaagaacgacgtccctctcgcaggacccctgatagctggcggtatgttgatcgcctgttatgtgatttcagggtctagtgccgatttatccctggagaaagctgcagaagtaagctgggagcaggaagccgagcattctggagcgagccacaatatcctcgtggaagtccaagacgatggcacgatgaagattaaagacgaggagcgcgatgacactctgaccatccttctgaaggctacattgctagccgtttccggcgtgtacccaatgtcaatacctgcaaccctgtttgtgtggtatttctggcagaaaaagaagcagcggagtggggtcctctgggatacacccagcccaccggaagtggagagagccgttctggacgatggaatttacaggatccttcagcgtggtttactgggccgctctcaagtaggggtgggagtcttccaggacggcgtgtttcatactatgtggcacgttacccggggtgctgtgctcatgtatcaggggaaaagattggaaccttcctgggcatcagtcaagaaagacctgatcagttacggaggcggctggaggttccaggggagctggaacacgggagaggaggtgcaagtaattgccgtcgaacccggtaagaatccaaaaaacgtgcagacaactcccggcacctttaagacacctgagggggaagttggagcgatagctctcgatttcaagccaggcacctccggttctcccatcgtgaatcgagaggggaaaattgtcggactgtacggcaacggcgtggttactacctcggggacatatgtgagcgccatcgcacaggccaaggcttcacaagaaggacctcttccggagattgaggacgaagtctttaaaaagcggaatctgacgatcatggatttgcacccaggttccggcaaaactcgcagatacctacccgccatagtgagggaggcaatcaagcggaagctgcgaaccctcattttagctcctacaagagtagtggccagtgaaatggcggaggccctgaaagggatgccaatccgctatcagaccactgcagttaagtctgaacatacaggaagggagattgtcgaccttatgtgccacgctaccttcacgatgcgtctgctcagccccgtgcgggtgcctaactacaatatgatcataatggatgaggcccattttactgacccggcttccattgcagccagaggctatatctcaacaagggtcggtatgggggaagccgctgcgatcttcatgaccgcaacccccccaggatctgtagaggcctttcctcagagcaacgctgtgattcaggatgaagagcgcgacatccccgaacgaagttggaattccggctacgattggataactgacttcccaggcaaaacagtttggtttgtgcctagcattaagtctgggaacgatatcgccaattgtttgagaaaaaacggaaagcgggtcattcaactgtcaaggaagaccttcgacacagagtatcagaaaactaagaacaatgactgggattacgtggttacgaccgacatctccgagatgggtgcaaacttccgcgccgatcgtgtgatagaccccagacggtgcctcaaaccagtcattctgaaggatggcccggaaagggtgatccttgctgggcctatgcccgtaacagtggcgagtgccgcacagcgccgaggaagaatcggccggaatcagaacaaagagggtgaccaatacgtttatatggggcagccactaaataacgatgaagaccacgctcattggactgaggccaagatgctgttggataatattaacacccccgagggcatcattcctgcattatttgaaccagagagggaaaagagcgccgctgtcgacggagagtaccgcctgagaggcgaagccaggaaaacattcgtggagctcatgcggcgtggggatctgcccgtgtggctttcgtataaggtcgcgtctgagggatttcagtactccgaccgccgatggtgcttcgatggtgaaagaaataaccaggttctggaggaaaatatggacgtggagatatggaccaaagaaggcgagaggaagaaactccggcctcgctggttggacgcaagaacttatagcgatccgctggccctaagggagtttaaggaattcgctgccgggcggcgatcagtaagtggagacctgatcctcgagattggcaaacttccacaacacctgacgttaagagctcagaacgcattggataatctggtgatgctccacaactctgaacagggtgggaaggcctaccgccatgctatggaggaactgcccgacaccatcgagacacttatgctgctcgccttgatcgcagtcctgactggcggagtgaccttatttttcctatccggcaaggggctgggaaaaacaagcattggtctcctttgtgttaccgcgtcaagtgccctgttgtggatggctagcgtggagcctcactggatagccgcatccatcattctggaatttttcctcatggtcctgcttatccccgagccagataggcagcggactcctcaagacaatcagctcgcttatgtagtgattggcctgttgtttatgatcctgacagttgccgcaaacgaaatggggttactagagacgaccaagaaagatctgggaataggctacgtggccgctgagaaccatcagcacgcgactatgctcgacgtcgatcttcgtcccgcctctgcatggacactgtacgctgtggccaccaccgtcatcacaccaatgatgagacacactattgaaaatacgaccgccaacatcagcttgacagcaattgctaatcaagccgcgatcctgatgggtctcgacaaggggtggcctatatccaaaatggatattggcgtgccgctgcttgctttaggatgctattcacaggttaaccccctgactctcaccgccgcagtgttgatgctggtagcccattacgctatcattggcccagggctacaggcaaaggccacaagggaggcgcagaagcgcaccgctgccggaatcatgaaaaatcctactgtggacggcatagtcgcaatcgatctggaccccgttgtgtatgacgccaagttcgaaaaacaactcggtcagattatgcttctgatcttgtgtacgtctcagattctgctcatgcggacaacctgggctctgtgcgagagtatcactttagccaccgggccacttacaactctgtgggaaggatcgcctggcaagttttggaacaccacaatagcagtcagcatggctaatattttccgaggttcctacctcgccggcgcggggctagccttctctctgatgaaatcattgggaggcgggagaaggggaacgggcgcacagggtgagaccctgggggagaagtggaagcgccaactcaaccagcttagcaaatccgaatttaatacttataagcggagtggaatcatggaggtggatagatctgaagctaaagagggcctgaagcgtggtgaaacaaccaaacacgccgtaagcaggggcactgcaaagttgcggtggttcgtggagcgcaacctggttaagcccgaggggaaagtgatcgacctcggatgtggccgagggggatggtcatactattgcgctggcttaaagaaagtcacagaagtgaagggttacaccaaagggggaccgggccatgaggaaccaattcctatggccacgtacggctggaatctggtcaagcttcactccgggaaagatgtgtttttcatgcccccagagaagtgtgacaccctgctatgcgatatcggagaaagtagccccaaccctacaatagaggagggtagaactctcagggttctgaagatggtagaaccgtggttgcggggcaatcagttttgtattaaaatcctgaacccctatatgccatctgtggtcgagaccctcgaacagatgcaacgcaagcatgggggaatgcttgtgagaaatcctctgtccaggaactcaacacacgagatgtactgggttagctgcggcactggtaatattgtgtcggccgtcaacatgacctctcgaatgttactgaaccggttcacaatggcgcaccgtaaacccacctatgagagagacgtggatttgggggctggaactcgccatgtagcagtggaacctgaggttgccaatctcgacatcataggccagaggatcgaaaacattaagaatgagcacaaaagtacgtggcattacgatgaagacaacccatataagacatgggcttaccacggctcctatgaggtcaagcccagcgggtcagcctcctctatggtgaatggagtggtccggctgctaaccaaaccttgggatgttatcccaatggtgactcagattgcaatgaccgacacaacgccctttggtcaacagagagtattcaaggagaaagtggacacccgcactccgagggccaagcgaggcacaacccagatcatggaagtcactgctaaatggctttgggggtttctgagccggaacaagaagcctagaatttgtacaagggaggaattcacccgcaaagtgcgtagtaatgcggccatcggagcagtttttgtggatgagaaccagtggaattccgctaaggaagccgtcgaggacgagcggttctgggatctcgtgcacagagaaagggagctgcataaacaaggcaagtgcgcaacatgcgtatacaacatgatgggtaaacgcgaaaagaagttgggggagtttggaaaagccaagggcagccgagctatatggtacatgtggctgggcgcccggttcctcgaattcgaggcgcttgggtttatgaatgaggaccactggttctctagagaaaactcactgagtggagttgagggtgaaggcttacataaactggggtatattttgagggatatctccaagatcccaggaggcaatatgtacgcagacgatactgccggttgggacacccgcattacggaggatgacctccagaacgaggctaaaataaccgatatcatggaacccgagcacgccctgctagcaacaagcatttttaagcttacttatcagaataaagtggtcagagtgcagcggcctgctaagaacgggaccgtgatggacgtcatctctaggcgtgatcaacgaggatcgggccaggttggcacatacgggctgaacactttcaccaatatggaagtgcagctcattcgccagatggagtcagaaggaatctttctgccaagcgagttggagacgcccaacttagccgaaagagtactggactggctcgagaagcatggtgctgaacggcttaaaaggatggccatatccggcgacgattgtgtggtcaagccgatcgacgatcgcttcgcaacagcgctgaccgccctaaatgacatggggaaagtgagaaaggatattcctcaatgggagcccagtaaaggatggaacgactggcagcaggttccattttgctctcaccacttccatcagctgatcatgaaggatggccgggaaattgtggtcccttgtaggaatcaagacgagctcgtgggtcgagctcgtgtaagccagggggccggatggtccttgagagagactgcatgcctgggcaagtcatatgctcagatgtggcaacttatgtactttcaccgccgggatctgaggctcgccgcaaacgccatctgtagtgcggttcccgtggaatgggtcccaacatctagaaccacttggagcatacatgctcaccaccagtggatgaccacagaggacatgttatccgtgtggaatcgcgtttggattgaagagaacccctggatggaagataaaacgcatgtgtcaagctgggaggaggtcccttatctgggcaagcgggaagaccagtggtgcgggtctttgatcggactgaccgccagggcaacttgggccacaaatatccaggtggctattaaccaagtacgaagactcataggtaatgagaactaccttgactacatgacctccatgaaacggttcaagaatgaaagtgatccagagggcgccctgtggtga
